United States Patent 12,616,207 (BOXWOOD ENDOPHYTE BURKHOLDERIA SP SSG AS POTENTIAL BIOCONTROL AGENT AGAINST A WIDE RANGE OF PATHOGENS) - sequence listing, part 5

SEQ ID NO: 5 - DNA, 1365651 bp, Burkholderia cepacia strain SSG
gattggcgcggcaccgtgtgccggcaacggacgaacgatcatcaagattccagcgtaactgcccgcatcggcatgtgcttgacgcgcgtcaacaggagcggacgctcaggtgcagaaccggaaatagccgctgtggagcaggatcggccggccgcccatctcctcgagcaggcagcgcgcggcgcgctcgatcgcgggtcgatgacgggcgaatgcctccacgagatcctgttcacgcggcgacgccgcgcggaagtgatcctccagcgcttccgcggtgatcgcgcagtgcacacggcggccttcgaccagcgcgggaaacgccagcgcgggatcctggctgcaatacgtcggatgttcgcaaggaaaggagatctgcatgatggtcacctgtgcaggttgcgcatgggtgggcgcgggctcgcgttgcgccgggtgctgcccgcgtcctcgccgcgggcgccgcgcgcgaatacgctaggctgccgccgccgcggccggggcggcatcgccggcgcgtacgagcaggaccgggcaactcgatccgcgcaggaaacgctccgcgacgctgccgagaaacaaccgccggacaccgcggcggccgtgcgtgccgatcacagccagatcgatcgaacgctcgacgacgtaccgttgcagccgttcggcgacattctggccaggctcggtctcgacgatttccgtgtcgccgttgaccgccgcgtgcgagatcgcccgttccgcgctgcgcagctcgccgcgccatcgcgccgaacctcgtcgagcagcgcgtccggatccattcgtccggcgtacgtcaccagaagcgagcggtcgacgacgaaaacggcgaacaggcgcgcgccgtacgatcgcgccaccttcagaccttcgtcgagcgccagtttcgatgaaggactgccgtccacggcgaccatgatgttcgtgtacataccgacctcgctggatgaaccgacgcgccggcggcgtgcggatgggtgtcatcatcggcgttcgccggacgcgggcgttgacggaggtcaacggttcgaaatcacgtggaggcgcgcgggcgcacgggcacgagacgccggatcagcgcggcgcgaccggctgcggcgcgccggggaacgcgcctggctcacgtcggcccggaagcctcgctcgatgtcgaggatcttcgtcgcgcacgcgtcgtaccgccaccccgggccgccatcgctgccgtacatgcccttgcacatcgccttgagccggatcaccgccgcgccgccgcccgatgcggtgcgcgaggcccacaaatagacttcgccggccaggaacggcggcgccgtctcgatcgtgtctgcatcggcccgggtgatccgggtcgacgaatgcccttcgacgtagcggcgcgcaaggcgccatgcgcggtcgcattcggccggtgtcgaacactgcagcgccgcggcctggcgcgtcgcgaacaattgcgtttccgtcgaccggaaggccgcgttccgctccgcatcggcgcacgcccccaacgcgagcaacacgacgaccgcccacacccgttgtttcatcttccctgcctcgcaacgcatcgcgttccgctcgccatccggcggcatgaatccgctcgacgccaacccggccgcgtgacgcaccgacatcccgcattcggtgcgcggtcacgtgccgcatcgcccgacgcccgaatcgactgtagggccgccatggggaatgcggttgacctgcgtcaagcgcgtgccggcgcggtgcgtaccgcacgcgccgcaacggtgccgacgacgtgcatgcgggcggcgttgcgccgctaccgcgccggcgccgggccacggcaagccgtccgggtgcgcacagtcgacgcgcttgacacgcatcaagccgggatgggcgacagtcggctgcaatagggttcgtcgcacgcgtgcctccgagcctgccggcccgatcccgcgacatcgagcagacggagcgtaccgcttccgttcgactacaacccgcgggcacggcgccatgcaagcgccacgcccatcgatccgttcatcatgtcccgagcgccacgcctgccgttcacgtcgagccgcggagccgcacgacgcaagaccctgcaattcgatcgcgcgttgcgtcgacctgccacctatccgcatcccgccggccggatcgaacggatcgaaacccacctgtccgtcgtgtatctggcgggacgctacgcgtacaagcgcatcaagcccgttcgattcgcgttcgtcgatctcgtgcgccccgcgcagcgccgccgctgcgcgctggcggaatggtcgctcaaccggccgttcgccggcccgctgtacctgggcgtctggccgatcgtcgcgcgcggccgccgcagcactttcggcccgcccgtgcgaaccgcccccaccgccaccggcagccggcggtgcccggcgagtatgtggtgcgcatgcgccggttcgacgcgcaagcgatgttgtcggtccgcagcgcatcgcacgacacggggctggcggacgcggacgcattcgcgcagacgctggcccgccatcatctgcacgcgccgcgccgtgcgccgcgcggctaccgggcagcgcggcgagcgtcgcggcccaatgccaggcgttgtgcgacacgctcgacgtcacggtgcccgctcaagccgcgctgcgacgctggtacgaagccgagctggctcgtctcgcgccgcagttcgccgagcgggacgcgaacggcttcgtgcgcgcctgccacgggatctgcatctcgacaacgtcgtccgctggcgcaaccggatcctgatgttcgactgcatcgagttcaacgacgcgctgcgctggatcgacgtggcgagcgatctcgcgtttgcgtggatggattatgccgcccgcgggcgggcagattgcgcccgcctcctgtcaggatggctcgcaggtacgggcgaccatgcggcgctggccgtactgccgtgctacttcgtctatcgtgcgctggtgcgtgcgctgaccgcgcggctgcgcggcgacgaagcgacgcgcggccgctatctgcgcgttgcgtcggacatggcgcaggcacgccgcgatgcgcggccgttgctactgctctgccatggcatgtccggttccggcaaatcggtggcgagccgcgcgctggcggaacggctcggcgcgatccggctgtccagcgacgccgaacgcaagcgcttcgccagcgcaccggaggacaccgtctgccgcccgccgcttactcggagacggcgatcgacgcggtctacgacagactgcgcgcgcaggccggagaggtcctcgccagcggctatacggcgatcgtcgacgcgacgttcctgctccggcgcaaccgggcgcccttcatttcgctcgccgagcagcgcggcgtgcgcgtcgcgattctcgacttcaccgcgagcccggcgacgctcgccgcccgtgtcgcggcccgggccgcacacgggcgcgacgcatccgatgccgacacggccgtactggcccggcaggtcgagcgtgccgagccgctggccggagccgaggccgcgatcacgatccgcttcgaaaccgagtgcgacgtcgcggcgtacgggagccgcgcgttctgggcgccgttgttcgccgcgctacgcgcggcacgcgcgccgcgcgccgccggagcgcggccccgacgggcagcacgacgggcacgacgggcgccacgcagggtcggcacgtcaacgtgccgccacgcgggccgtggcgggccccgggcgacggctgcccatgatccgcgccctgcgcgacgcacggctgacttgacgccatgtcacgccgttccgtttcggccggccgcgacacgaacggggtcgcgcacttcgcccacctgcgcggccgtgctcggcgcgctcgtttcctcttcgtgcggaaaaagcgcggggacgtgcgagtgtagcgcccgttcccgccgcctggacgccgacgccgcctagatgctgagataccctggaacaaccacggggccgcttcgatcccgcaccgcatggccgctcgcggccggcgcgcaggtgcccgagcccggcgatccatccgcccagaacgacggcacgaaggaaaactcgccgttgaccgtcacgacgaagtcgcgattgaatggcgacggcgcgaagatcgtcacctcgcggaaaaacggcgcggcatcgtcgtgcaagataccgcccgcacgtgtccacctcgcgtcgtagcgagccggcaacgtatagatcctgccgccgcactccaccgttccggccggcgtgtacaccatctccactcccggatacggcaggcggtaaggctcgcggcaaaccgggccgtcgggtccgaccacgagcggcggatgcgcccagatcgatagcgacagcgggctcgtgtgctgtgcgaaatattcggaaagccagttcatggcccattctcccgtctacggtcattggcgtgcgcaggtgccggcaggttcgctgaagcggcgcgatcgcgccggcggcccgtcgagcgtcgcacgacacgctcgctgccgatcgcaaccgaaagcctgaacgactccgccggcaaacgcccggcctgtttcggcgcccgtgaagtcattctcgaacgcaccgcgcgccgggcgttgacggaagtcaacggacgcggcggcacaccgccgttgccgcgggccggggcccgcatgatcaacggccgaaggtgcgcgtatggtcgtcgtagtcgaacagccccgcgtagcggcccagtccgtcacgacgcgcagcgcctgttccgcgctgcgcggatcgagatgatcctcgagctccagttcgaaacgctcacgcggcgcgcgatgccctgcacgctcgtccagcacttcgtcgatatgcgcggcaagcggcacgaacttgacgacatgctctcgaaacaggcgccgccgggctcgtcgtcgctgtgcgcgaacacgtggcccgccgcgctcaaccggagggtccggtcgtgccactcggcaaaggcgagcagatggagcgccgcggcggtcgcatggagcacgtcgacccgaagcgcgagcgccgcggcaatcgcgccgagttccgcatggccgtcgtacggcgcggccgccagggtctcgacgaacccggcgagatggtggctcgtcacgtcgggtagcgtcatggccagcgtgccgccggccgccgcgcgggccgccgccgcgtcggcgatgcgcgcggtcagcgtcgcgtagatcttgccgacgatcgcctggaaagccgggtcgtgccggctgcgcggacgcggcaacggcacgttcagcgcggcgtcgatgcgcgccgggccggcgccgagcaccaggatgcgatcgcacatgagcacggcttcctcgatgttgtgggtcaccatcatcaccgaccgggtcgacagctggcgcgcgtcccacaggtcgagaaaatcggtgcgcagcgtttccgcggtcagcacgtcgagtgccgagaacggttcgtccatcaacagcaggacgggttcgctgacgagcgcgcgggcaaccccccgctgacgcatgccgcccgacagttcgcgcggataagccgattcgaaaccgtcgagcccgatcaactcgatcgcgacggccgcccgttcgcgcacgtcgcgtggcgaaaggctcagcgcatccagcccgagctcgacgttttcgacgacggtcagccacgggtacaacgcgaaggtctggaacaccaccgcaatgccggcggtcgggccggcaagcggtgccccgcgatatgcgaccgcgccggacgagggcttgacgagcccgcccgcgatccgcagcagcgtggacttgcccgagccggagcggccgagcagccccagtatctccccctcgcggagcgtgaggtcgatatcggccagcacgtgcagcggctcgccggacggcttcgtgaacgatttgcatacgccgcgcatctcgagcacgacgggagcctgctccgatgacggcgcggccgcgcccgcctcgtacgcttccttgcattcaccgggattcgacacatcggtctcctgcggatggacgatcgggtcggactcaatcgaaccgcgtcctgcgctcggcgaacgcatacatcgggcgccacacgagccggttggtcgcgatcacgagcagcgacatgacggcgacaccgagcgcgatacgcggaaagtcaccggcgccggtcatctgcgcgatgtaggccccagtccgccggcattcaggcgcgtgctgccccagctcaccgcctccgctacgatgctcgcattccatgcgccgccggacgcggtgatcgcgcccgtcacgaagtacggcagcacacccggcaacatgacgcgacgccaccaggtcgccggccggacccgaaagcatgccgccgcttcggtcaggtcggccggaaacgcgctcgctccggcgatcacgttgaacagcacataccattgcgcgcccaggatcatcaacagcggcagccagacttcggggcgagccggtagcgcacgatgacgaacaccgcgaccggaaacaggaggttggccggaaacgcggcgagaaactgcgtgatcggctggatgcgggcggccacgcgcggtcgaagaccaatcgcaatgccgatcggcacccagatcgccgacgcgatcacgaccagcaccgtcacgcgaacgaaggtgagcgcccttcgccgccacgacgcgcaggtccgcccaggtcagcgccgcgcgtccgagccggaacagtacaaccgccgcatacccgcatcccgccgcgcacagcgcgaaccagagcgcgtcacccgcgtgccgcggcagcgccatccggccgcgccacggccacgcgaccccgggcagccgcgcgcgccgcgcggcagcatgccgaccgggccgccggcgcgggccatccatcgcgaccggtggaacaggtcgagcatccagctgcgcggcacgaccgcgggcacggcatcgccatagcggaaccgttccgaccacgcgaccagcggcctgaacagcaactggtcgtacaggacgatcgcgacgctcatcgcgacgatcgcccagcccaccgcggccaggtcccggttcgcgatcgcccgtgcgacataggcgcccacgcccggcaggtcgacgtgcaggtcgccgaccgcgatcgcctccgatgcgaccacgaagaaccagccgcccgacatcgacatcatcgcgttccagacgagaccgggcatcgcgaacggcacctcgaggcgccagaagcgctgccatgcggagagccggaagctgcggcttgtctcgtcgagatcgcgcggcaccgtgcgcagcgactggtagaagctgaacgtcatgttccacgcctggctcgtgaagatcgcgaagatcgccgcacactcggcgcccagcatccgccccggaaacagcgacaggaagaacagcaccgtaaacgacaggtagccgaggatcggcaccgactgcagcacgtcgagcaacggaatcagcacccgctcggccgaccggctcctggccgccgcggtcgcgtagacgagcgcgaaggcaatcgatgcgagtaatgccgcgaacatgcgcgagaccgtacgcagcgtatagccgggcagcgccgcgggggacaacgagatggccggggatgcgcgaccgcgagcgggcctgccatctggtgcgccgaaatgccggtcagcatcaggaacccgatgacgatcagcaccgcggcgagatcccgccagcccggcgcgggcagcgtccagcgcccgccgcgcaatacctccgcatggtgctcaagtgcccccggccgatgatggcagttcatcttccggggcgggcgggacagccgcgttgacctgcgtcaaccgtcccgcaacagccggcccgggtcgggccgacggatgcgggcgcgtcggcacatgagtcgattcatgcggcgggatacgcgttcgcgagcgcctcgacgaacgcatcgaggcacgcgggcgcgagccggttgatgccggccgccgcttcccggccgccgccgtccggaaatgcgcggcaaagccgatcggcaccgtacggtgcggcgaccggcgcgcgcacgctgaccgtgtatcggcctcccgccgcaacggtcagcaccgcatgcgcgcgcggctcccgccgcgcgagcaggttggcgaagacgccacggacgcgccgcgcccagcgggcgtcgggcaggatgtagacgtccgcgcccggcagcacgaaggtcgcgcgctgccgttgcgcacgcgcgatatcgcgccgccggttctcggccagacgtcgcgcgaacggcgaccccgcgaaatcaagcggattcgcgaattgccggatcaccgcatacacggcaagcggcgccatgaagagatcgtcgggaagatcgccgtagccgttgtagttgatggattcgccgagcacctgcagccggcgtgcatcggcatccgtcaggctgccggcggcggcgagcgcgccggccacgccgtcgagattgtcgccatacgcgcccaccgccgcccagagccgctgccggccggccagatagcggtcgacaatgacgctcgtgcaggtgtccggcgccgtatcgatatgcgcatgcaggtggggatgagcgggcgtcgcccgtcacgtggtgatcgaaatagtcgacgtcgacgcctcgcgcgagcagcgcaaccagggcctcgcggttcgcgtcgagcgaaacgtccaggacggtgacggcgtcgccgcggatcgcaggcacgcgcgccagcagtgcaatgtcgcgcttggggcccgtcacgagcaccgactcggccggcgtcacgagccggagctggtgcagcgcgcagatgccgtccgcatcgccgttgaatacgtcgaagcgcgtcatggtgcgccgcgcccgatgccgccggggtgttgcgtgccgtcaggacgcgcgcaacgcgtgcgcggggccgccaccatgcggcccaccgcgatcgagtgaccggtcgggctgcgagcctcgttcatgccgcctgccgcctcgcatgcgcgtccggccgccgccccactgcgcgacgcatgccgccagcgccggagaaatcgacgcctgcagcggcaccacgggcgccagtgcctgcatggcgtccggcagcgtggccagttcgcgcagcgcgtgcacgcgactctcgtcgagcgtgggcgccgcaagccgcgcgcccgcgaccatgaccggctgcaacagcggcgttccgtcgaggcgctcgccgtccagaccgatgcagtcgccggcgatccgcccgtccgggccgtatcgccggaacacctgcttgcggcccggcagtgtcgccttgccctccgagcgcttgcagcgcgtccggcccgcgtactcgaccagcttgtacgcgcaatcgagatacggcgcgtccgccgacgtgcccatctgcgtgccgatcccgaaaccgtcgatcggcgcgtgctcgcggaccagcgcctgcaaccggtgttcgtcgagattgccgctcgcgaagatcgtggcgtcggtaaggccgccgcggtcgaggatcgctcgaacgttgcgcgcatgcgccgcgagatcgccgctgtcgatccgcacgcccttgatgcggacgccgtcgcgcgcgagccgcggcgcgagttcgaccaccttgtacgccgcgcgctccgtgtcgtacgtgtcgatcagcagcaacgcgttatccggctgcgatcgcgcgaagtgttcgaacgcgagcgcttcgtcgtcgtgcgcctgcacgtacgaatgcgccatcgtgccgtaaacgggaatgccgtagcgcaagccggcaagcagtgtcgccgtcccggaaaaacccgccagatagctggcacgcgccgacagcatcgccgcctccgcaccatgcgtgcgccgcagtgaagtcgaccagcaacctgccgtgcgcgacgcgcgtcgagcgtgcggccttgcttgcggtcagcgtcgcatagtggagcaggttcatcacccggctctcgacgaactgcgcctcgcgaagcggcgccgtgatccgcaggaccggttcgtcggcaaagaacaccgtgccttccggcatcgcatcgaccgtgcccgtaaagcggaatccggcgagcgatgcaagaaagtccgcgcgaaggcgcccggttccggccagttgctccagtgcggcgggcgggaagcacaggcgctccagataatcgagcacgggcgcgagccccgccgccagcaggtatgcgcggtgccctggcaacgcccgcacgaagaattcgaagctcgccgcgtcgttcatgccggcatcgaagccggcctgcatcatcgtcagctcataccaatccgtgagcaacacgtcgtcgacgttcgcctcctgcaaggatccgttcatcatgcccctcccgcgcggcaggtcgcgtcgatgccggccaccatgtcggcacacccagcataggggccgtccggcgcccgaattgcgcgagatcaaggagcggcgttcgaacacgccgccatcgaacaggcacgcgccgggtgccggaaacatcgcaccgggtcgtgaaatcaggatcgtgttcgcgcggcacgaacggttggacggactgcctcccggatgcccgccgacgatgcgcggaacgccgccttgcgggggtcgtgtcgacagcgctggcgatcgcaagcacgcgatgagcgcggtcggcgttcggaaggtgaacgtgtccgatttcttcggatcgacacgggccatgccgccacctgaaacctccagcgccgcttcgcgcgcggccgccacgggcacgccgcgacggaacgcggcgcacgccggatcagtcgcgttgcttctcctcgaaatacggctgacgcgccgccacgaggcgcaattcgtcgagcagcgccgcggccacgcgaagcagatcgtcgagcgagacgataccgaccagttcgccgtcgtcgccgacgaccggcagccggcgcacgccgtgctgacgcatccgcttcgcgagcagccagacgtcgtcgtcgacatccgcgacggcgacgggcgcggacatgatgtcgccgacgaacagcgcgtcggcctccgcgtcggggctgaccacggcgagcacgatgtcccggtcggtcaccatgccgatcggcttgcatcgtccgtcctgttcatggacgacgaccaggtcgccggcatgcgcgtcacgcatcctggcggctgcctcgacgacggtcgtccgtgcgggacacgtcgcgacatcgcgggtacagagcatcgcagcattcatgttcgttctcccggtcggggcgaagcggatcgtcggcgcgtgacgcgatcggttcccgtcgccatgagcgcccgttcgcatccggtgaaaacaacggtaaatccggccgcgcaaccggcaattgatgcaggtcagcgcggtgcgccgtgcggtgttccgcgcaatgccgtggccgtggccgtccggcgcgcggccgtgaagccggcgttgccatcgcggccggggcgatcgcactcggcgaagcgcgacacgatccggcagccgtcgtccgacaagcgcgcgggggcctccacaagcgacgcggtatcgagtcgcacgaggccgcgatcgaccagacagcgaaggtcggcggggtcgccctgctggcatcgcggctcgctggcgagcaccatcaggatcgcgatctcgtggggactcagcagccggtcgccgtcggcgtcgaccggacgattccggtgtggcgcgacgggcggcgtgatgatccggggattcgacgtgtgcgcaaacagggaaggcatgatggaggcccgtatcatgaacgtgaagacgcagacggcacggcgcatgtcggtccccgatcgtgagcgacacgcgcaaacgtttatcttcgctcctgcgcaagcggtcttgacgcaggtcagcaagcgcacgcacgcgcccctcactatctgcgattcatctgacgcgatgccatccggagatccgctttgcttgcctgtcaggaacacgtcaacctgatcgtttagcctttggtcgcaggatcggaacgtcacggtagcgtacgtatcttctcgtcggccgctcggactcccgctcacggtcgcacgtcgtccctatcgcgctccgcatcatcccgttttcttccgagagaccgaacgtcgtatccggcttgcatgaaatcaatgcgtcacggacagccggaatccaccatgaatcaccgtcctgaagagatccattcatgaactggtactacgaagtcgaacgcgagctcgcccacatcgaaggatccattcgactgctcgaacagacgcggggctacttccacaagaagacgtcgatcagcgatcccgcatactggcgtgcaagactgcacgccgtcagggcgacggccgagcaggacaagacgctgttgcgccgcgccgacgaaatcctcgcacggctcgatcggttctgatccgctcgcgccgtccgcttgtattcccgatacgtaacgagtcggacgattcgggcaagatcagcgccgcacacgggacgtacctcgatcaatccggcgaagccccgcacggcgcgcaccatcgagtgcggatcggcccgaaccatcgtgcttgatcgccatcaacgcgccgccgcggcatcgctcatggattgcaaggaagcgcgcgggacgattcgcatcgcgaaacaggtagccgaccaagccgaacgaaaccgaagcacgccacgccttgctcatgcatcttggcggcaacccgggaggccgggcgcgctacgtcgcgtcgctcggctccgggatccctggttcggccagggcctcgcgccgtcgtcaggcctgcgtccggcgcgggccgcaccggtcgagtgatcgccgttcacgcacggcaagccgtcgagcgatcgaccggacaaaacgcgcgagtttgcgggacgccagaccgtgaccgatatcgcgcgcggaaatcgcgcaggtcgcgatcggtcgttgccgtgccagcgcctgcatctgtccgaatgccgtcaggtcgccacgcaggcccatcgtgcagaagaatgcggtcgcgtgcagttcgtgcccgtgacgggcgagccaggtcgacaccggcgtcgaggcgcgcccggcccagaccggcgtgccgagcacgaccacgtcgtaggccgacggggacgagaccgtcggccgcaggtccgccgcgcgttggcggatcacgtcggcaagcgaacgcagataaccgatggcccccgcccgccgtcgatcgtcgagctcccgcaaccgttcgcaatccgcgccgagtgccgctgcaagccggcgcgccagccccgccgtcgtttcgctgcgcgagtagaaaacgacgagcatgcgtcgagaagcatccatggtccgctccgtgctcccgcccaggatccgacggtcagtttaggcaccggcggtcgagccgacgctgatgcaggtcaacccgccgccgtgcaatccggcgacagtagacttgtccgaatccccggcggcttctcgtccatgcgcaatgtggtatgacctgattgaacagcaacggcaatggtggcgcacgtgggacgcggccgcgcggttcgcgcgcggtctctggcccggtgtggcgacggcgtgttacgccgatctggtcgagcccctgctcgacctgcatgccggtccgccgcggttcgcgatcgattcgatcgccctggacggccgacgtgtcgacgtcgacgaaacgatcgtcgcgcacacgccattctgctcgctgcgccgctttgctcgcgccggcgcaccgcgcatgattcttctgtgcgtgccgctggccggccatgcggccgtgatgatgcgggaaacggtcgagacgctgctggccgatggtgacgtctgcatcaccgactggatcgatgcgcgcgacgtgccgccggacgcgggtcgattcggcctcgacgaatacgtggcgatgctcgacggcttcatcgatacgctgctggccgatgcacggccccttcacgtcgtcgccgtctgccaggcgacggttccgtcgctcggcgcgcttgcgctgcgcgcgcaacgcggggccgtcccgccgggaagcctgacactgatcggcggcccgctcgatgcgcggatcaacccgggcgcgctcgggatggcggctcgctcgcattccctcgcatggtgtcgcgccacgttgatcgacacggttccgcccggcttcgccggacacgggcgacaggtttttccggcctatctgcaacgcgccgagatctcgctcgcgtatccgcagcactacatgacgctggtcgatcgctatcgacgtgcggtgacggagggcgatgccgacgcactcgcgcaggcgcgccatgcactacgcgaatacctgacgctcctcgacatgcccgccgagtacttcctcgacaccgtcgacatcgtgttccagcgtacctgcctcgcaaacggcacctggttcgtccgaggtcagcgtgtcgaccccgccgcgctgcgcgccatcctgctgctgaccgtcgaaggcacgcacgatgccgtcaccggcgcgggacagacccatgccgcgcaggccatgtgcagcggccttgcaccggacgcccggcagatcgtcgacgtcgaggattgcgaccactacgggctgttcacgggtgagcgctggcgcaccgtcgttcatcccgcgctgcaggccgcgtttgcccgcgccgaacgcggccggccgtgcgcgtgcgcggcgcagcgtgacctgacgtcgtccagctgaaccggcacgatcgcgcgcccgggcgccgcgccgctcaggccggcggcgtttgcgcgccgcgcgctgcctgttccgcggccgccacgcgacgcttgaccccgatgaagctgtcggggctcacggaaaccgagtcgatgccgcaggcgacgaggaaatcgacgaattccggatgatcgctcggcgcctggccgcacagtccgaccttcgccccggcatcgtgcgcggaggcgatcacgcgggcaatcatccacttcaccgcttcgttgcgctcgtcgaacaggccggccagctccgccgagtcgcggtcgaccccgagcgtgagttgggtcaggtcgttgctgccgatcgaaaacccgtcaaagcgctgcgcgaacgcgctcgccagaatgacgttcgacgggatctcgcacatcacgtagatctgcaggccgtcttcgccgcgcttcaggccgttcccggccagcacctcgagcacgcggtccgcctcgtcgggcgtacggcagaacgggatcatcacgatcacgttcctgaaccccatgtcgttgcgcagccgcgcgatcgcccggcattcgagcgcaaacccgtcgaggtagcgcggcgagtagtagcgcgacgcaccacgaaatccgagcatcggattctcttcgtgcggttcgaactgcgcgccgccgacgaggtgcgcgtattcgttcgtcttgaagtcgctcatgcggacgatgaccggtgcgggatggcagaccgccgcgatgcgcgcgaggccgcgcgccagccggtcaacgaaatagtccgccggatcgtcgtagcccgccgtcagcgccgcgatggcgcgcttcgcccgctcgtcctgcaaggcgtcgtagcgggccagcgccatcggatgcaccttgatgtggttgctgatcacgaactccatgcgcgcaagcccgatgccgtcggccggcaggcgccaccacctgaaagccgcgcccgggttcgcgaggttcagcatgacctgcgtgcgggtggtcgccaggtcggccaggtcgatcgcttccacgtcgtattgcgcgatgccttcgtaaacgaagccggcctcgccctccgcgcacgacaccgtcacttcctgctggtcgtgcagcacgttcgtcgcattgccggtgccgacgatcgccggcaaccccagctcgcggctcacgatcgcggcatgcgacgtgcggcccccgtggtcggtgatgatcgcggcggcgcgacgcatgaccggcagccagtccggatccgtcgtgcgcgtcacgagcaccgcaccgtcgacgaagcgcgccatgtcgcgcgggctgtcgatcacgcacacgctgccggccgcgatcgcctccccgacactgacgccggtgagcagcttccggccggtctggccgagccggtaggtcttcacggcgctggcttcacgccgggactgcaccgtttcgggacgtgcctgaacaacgaacagttcaccgctgacgccgtccttcgcccactcgatatccatcggctggccatagtgcgtttcgatcgcgcaggcccagtgcgcaagcgccaggatgtcgcgatccgccaggacgaacgcggcacgctcggctttcgacgtcggtacgttgcgggtcggcgcatcctcgtcgcgcgcatagatcagcttccgcgccttgccgccgagcgtcttgccgatgacggggctgcatgcgggatcgccgagcaggggcttgaacacttcatattcgtcgggatcgacgatgccctgcaccacgttctcgcccagccccatgcggcactgatcagcaccaccttgtcaaagcccgtttccgtgtcgagcgagaacatcacgccggccgcgccgacatccgaacgtaccatccgctgcacgccgatcgacagcgcgacacgcagatgatcgaagcccttttcttcccggtacgcaatcgcgcggtcggtgaacagcgatgcgtagcaccggcggcaggcagcgagcaacgcgcgctcgccgcgcacgttcaggtaggtttcctgctgccccgcgaagctcgcgtcgggaagatcctcggcagtcgcactcgagcgcacggcgacgtcgacgtcgggtcgccccgactggcggcacagttgccgatacgcgtcccgaatcgcatcggcgatgtcgtcgggccagtcgccgtgaaggatcgcctgccggatcgccgcgccggcatcggcgagcggcatcttcctggcgacgaacgcgtcgagcgtgctgccgatggtctgcctcaatccgttcgcatcgatgaaccgccagtaggcatccgcggtcgatgcgaagccgggcggcacgctcacgccctgtgcggacaggttgccgatcagttcgcccagtgatgcattctttccgccgacgctcggcacatcgccgcgccgcaggtcgtcaaaccagacgatcaatgccttcccgtgatccatgatgcgccctccggtcgtcgcagccaggccacgcgcgagtcacgcacgtagccggcaatcgccggcacgggctgccggacacgtccatcctggctccatgccgcgccgccggcgtgacctgcgtcaagaacgggcgccgacacgggcaatgcgctgtccggcgcgcgattcgtctgcgcttgacgtccgtcaacggatcacgtcgctcgtcccgtacgctctcgatcaggggcatatcgatcgcgcctggccaacgacaggactccggacatggattgcatgcatctcgccagatcgtccgccttggcagtcgccgctgcctgggccggtttcgtggtaccgcttcatgcgcaggaaccgggttcgccggccgctgtcacgccgtcatcggccgccgcggcgccgtcggaaacagcggaaagtgagtcgcccgcttccgcgtcgcccccgcaacgtcgccttcggcaagacacgcgcgcaggtcaggcgagagctggagcaggccgagcgggtgggcgaaatcaagcgcatcgaccggttcttcggccgcggcagttgatcgccatcgcgccggcacctgcaacgcgcggcgcgtatcgaaaggacgatcgccgatgcgggtcggcgggtatcgcgcgagtcgtcgcgatcgcggtgatgtgggcttgtaccgtcgcgtcggaacgattttcagtgcgtatctatcacgcactggtccacgtaaattgactgacggtgtgtccgactaacattcgtgtcgaccacgcacgtgcttccccatcacacgccatagcagtagcctgtcgaccaacatctaacgccgctctcgtcatgaaagttagcctccgatagaagggcgaagtggccgcttatgcaaatctgagggtcatcgccgaaagttcctggacctgaaaaagcccggagctgtggggtcgagacggccccctcctccagactctcaagccaatatccagcgatgacgcgctgcagctgcacccttttgaaatatcgaaatagcatgctgtatcgttatcgcttgaccagcgatgacgcgactacccgatgacgcattctcaatttgcaattccgcgccatcctgcgcgtttcgatggttcccctcgtggaaaaagaacatttccggctgatcgagggggcaaattcaacgctcgaatcgtcctttccgatccgccccgaaccggacacgtgctccgcaggtagatatccaacaacggcaacgtggcacagttttgccaacgtcgacaattgaggagcgtcgattttgccggacaggtaaggaatctgagccgacaatccagaaaatgcagcacagacaagcgcctcgcggcgccgccctgattttccagtcgttcgatccattccggaacgacggacggaggcaaaacggtcatggcgcgataaaagagttcggggcaatccagatccgtccactgagcccgccaaagccggtcgagtgcggccgcgccctcgagccggagcagcgccatgaacgccgcggaccttactgcgcggtcttgatgctcgagcagaatcgtcatgtcgcccgcaaagcgcttcaatccgaactggcgaaccgtattggcaatcgcggtcacgaccgccgatgccgaatcccgcggcgtggaagcaatgacggcatcagcctcttcggacattgctgcggcgttcagtcggcatatgacgtcgaaatcgttatcgagcccggcgagcctgaattcaccgatccgataccaggcaggcccgatccattttgcgatttttccatcaatggatagcgcggcacctgatcgtccaaccatgtccgatattcttcgagccgccctcgatcgcctcctgcgaacgcaacgatacccgctgcaaacaacatccccggcgtggccccttgagtgtcgatgcaatttctgatgcatcgccacgcggtcgcttcgcgcaatgtcagacctctcaagtgaccgagcaggcgcctgtccattcgaacgaaatcgtcgagcgtaaaatcggacaagagcgaagcccgctcacggacgcggtccagatgcacgatttcctcgaggtgttccgtacagaaacgctcggaaaacagttcgttgctatccgacatggcatcaggttaccgtcagtcgacggatttttcgcccgtctcgatgaattctcgataaatagccgacgagtgcatcgaaacacgccggatcgactctgaatacgtagtcgaaactcgaagcaatcgtatgcgaatcatactgataggtgccgctcgcgaacgttcccgcgttcgcgggatcgacgcccggcggagcgaagccgctccgggcgacaacgttcgcccatgtctcgatcgcggcacatatcggggttgcggcctctttggtgaggggctgatcgaactcgatttgtacttcacacccgcgaatcgaatcacgccagtcgagcttctgcacgaacgcaaatggcgcatcaaccgggggcgaggccattcccctgatccacgacaagctcccgctcgaccgcattcgcgtcaggttcttcaatgtgcacgatgctggagcgaatgcccatcgccgccagtagattggtcgcgacccgccactgccatgccggcagatgatccgtggcaacgcgccaacgttgcgtttcgctcactggatcccacgtcgacgacacgaccttcgccgatgcccggcgatgctcgcgagcatcgctcacataaaagccaagatcgatgtacccggcaaataacggcaagggatcggacatgaccagatcggaagtctcgagcgaggtcccttctgcattcttttcgagataagcgacgcccatgccgcgtcccgtgatatcgactcgcatcacgcatacctcgtcaatgattcgatcgatcgaagacatcgagccattcctgcaccccgtgctgccgaaactcccacggcagcaggccgccatccaccgaatcgagcctgaccggtcgcaccagttttgccacaggaccgtacgcagcaacgtaatcgtcgcgagaggagtctccgagctgcggctccggcgtggcctgcaggcacacaccatgtttgagccggcgcaaacgcaccgctgttccggcaatgtgttcctcgatcccggaaattccgccgatccagtcgacctgattctcgctcaggaaggtcaaccagttcgcccgtttcagatagggacgcgcaatggctgcctgatgccgctccgtgaactcggggtcgcgctgccgcaacttgttgccaacgccgaccatgacgctcgcgacatcgaacccaggatatcgctgcatcaacgcggctacccgattgcgggtttccgtatccagatcggggatggaaaattgatgggaaagttgagtccaaatccacaggatcccgaaataaagcgtctgttcgccacgatatcgaattcgcacagccagtctgcgacacgattgccggtcaccagcggatggtcgagcggcaacgtcaaattgaggatcgtgtgcatcgggagcgaccgccgctcggtcgcacgccattgcttgagttcgtcagccgacggttcgacatacggacgatgggcgaagtcgattcgcaggctgctggccgtcgccccgcatcggcgccattttccatcaagcaatagaatttcttcggaaaagggacggggttttcgcaccaggtcttgacgagactttccgcccgcttgttgatgggtttccagcgtccgtcgccggtgttgtagtgcgtcaggcgatcgcccaatgcttcccgcgcgcgcctgtagaaatcgaagatttcagtaccttcgtcgaactccatcgcccactcgaacaacaggcacggactgatcaaagcgacatcggcgctttcgaagccaagattcattgcgtcttgcatcacgctcctcacggaatgacaaactccggcaccatcccgcctgctccacccaggccgagagacggcaccccattgggaaattccaaagaggcatgccatacatccccatgcccggaacgggaacctgcttcagcacctcttcctgctgaaccttggttccctttccgcaaccacattctcagggtccagactcggatcctcaccggagtatggattacgtccgccgttctcctgctcgttgatcgtgttgtaatcctgacgctgcaaattaccattgcctgcacctgggttcgttcgccaggtatccacggttccatcggagcgcgtgaacttcagatcgagcacgctcgtttttccgccgttggttaccgtgaggtccggaaagcgcatctgttcggtcgcccctttcaggaaactgttgagcaggtgctgccaactggaatagttgctgttccagctgccatcggggcgttgccccaaggcttctgggactcgatatccatgtccttgttgccggttgcgtccttgtacttgtcccatgcttcctggaagcatttttccttatccgacatctttggcatatgaaattctcctgcatcaggcggttatcccgcccgtcggcacttccttgatcttgacgaagtcgccaccatcattccccgcatcgcaccagcaaaaatgcggcatagaattccgccctggtcgagcagattcgactggacctcggccggcgtattggtattcgggttattgccattcatcatcatgggatcggaaagcctcgcgacgttgcgcccttcgatcttgacgtcgtagctgtagttcgtaaatttcgcccatccgcgattgacgcccgacacgacgccgcctcccacaccaggctcgtcgccataactgggcttgaactccgactccttcagcgcagcgggaacgccattcgtacgaacggtcttcgatccattgaccagatcgcgcgaaaacgcaacattcgtataaggcaccacaccggcgcccggcgtcttgcaaaagtccggcgccgcgcaggtagcgattccccgcttttcgaatgaacattggtcagcttgttgacgatcactgtagatgccacggtgcctccccgtcatgagaacccatacgctcaagcaggcaggctgcgcgagacagcctggtatccgatgcggaaaaaaccagcgaacgccgtcgcggcatcacgatatccgtgagttcatcgtgcgccaacatacacagcattgcggcagacgccgccccgtatcgccccaaatctccgccgggtggctgatatcgagcgggtgcgcaaactggcggccgttacgcagaaacgcgaaatcccattcggcactgcgccaggtctcgccagtcaaatcgccatagcaattgtccacctggatgtcggtggacaagcactgcgagattgcggccgtcagtccgtcgccgcgcgacgcctgatcggcataccacggcatggtttccgtagcgagaccaacggcgcgcaatgcgacacgcgtcgtgttctccgctgacgctcgccccacgtccgcgcgcagaagagcaaaagccgccccctcaccgggaaccatgccgaacggattgtcctggtgcttgagtcggtcggtatcgtcgagccagtgcagataattcatatcgagcggcgagtcgaccccgccaacgatgcaaaaatccgcctctccagccttcaagatgtcgaccgacctggccagacccgcgataaaacccgtatgaccactgcaaaaaatcgactcccgctacgtgaaaattgcggcatcgatttgcagatttcgccagcgacggacgcgatatccgcgtgcggcaaaccgggacgctcgggcgggagcgaaagcagcaccggaatgggccttgccggcatcccggcggatgcgtccagaatgtgcccatgacgggccaataaatcgtccagcgcccggcgagccagctccgtcattcgcgatacacaggtcgcatcctcactcagacaatcgagcttcgcgagcgcaatggcaccgcccctgcgggcatacgggtagcgtttgtgtcgcgcgatgcgcgacacgctcgacagtacggcgttgcaagattcggcagcggacaagcccaccgacgtacacgcaccgaatccgctcaccacgatcgggctgtcaaactccatagaacctcccggtatgcagatcccgcttggtatcgacatacgtgacctgtacacgacgagcatcacgcccgcatgccaggacgctgcgccacaccatcaccaatcgactgtcgtccggctcgactatcacgcgatccagttgtgcgtgttgacgaatcgtccggccgcctattgtcgtcaacaggttgaaatgcacacgaggtagccgaaatgtcattttcgccgacggcgtcaggtgggcaagcacgacacgttcgccgcctcttaacggaactgcggtcgccatgcccggcgaggccgagttgaagaatgcgacatcgaaatcgtccggaaccagcggtgcgcgcgtcgtgatccactgttcatcagttgtaccgctgaagcgtgcacgcgccggccacagcggcgggatcgcattcatcccggccggcgcaggtcgatctttccacgatttgatcagatggcgcggatcctcgatatggggcagcttgccgtcgcgcgcgtcgtcccggtccacaaagaatcccatgcccagcggattgtcggagaatccgtccttttgccgcgaactcgttccgccgtaggcgaattcgtaccgtaacggccagcgcgaaaacaattcgggatccgtcatacgcagtccgaataacccagaatcccaacgacgcgcgccgaacaccctgatgactcgatgtatcgacccgatcgagatgccgacatcgagctcacgcaacggttcatcttcgggtgcgtatgccgaaccgttgaccatgatggcgctcccggatgcgcgaacacgatttcggcgtctcgcctcagggtcgagtgccccggctctccgaaatactccggatgcgttttcactggctcttgctgcttcgatagcgacagcgtaccgtcagcgtgcagatcatacgttgccttgacaaccacgacccacaggtgcccaccatgtcggtcgaactgcactgctcgttccgcagcgaacggcgtcacattttgcagttgcaacatgtcgctttcagttcagctcgacaaccgatccacgcaaccggagcgtaccttcagcataggtcgctacattcgtcccgcgaacgatgacgcgtccgtccttgttcaacgtgagacttgcctggccgcacttcagcgtcatcgcttcggccgcttcaacgcatacgtgcgatgcttccgtggtcgcagagatagccggcgtgatggcgtgaacggcggccctcgcctcggcttgatttcttgttccgtgccgacgcagaaggcccatgaggataggttgcgccgggtcaccctgcacgaatgccaataccacttcgcgcccgacgtctgccgcaacgacactcgtggcgcaaatcgcggcaagtggggattggtacgggttatcggggtagtcgatccagacaccatgattcgaatcgaccttggctatggttccgagaaccagctcagccgtccgttgggtcggcggtgcaacactcagtgcggcaatatgttctgcgactcccatctcagcccctaagaattgatatcgacgttatttccgctgattctcacagggcccgaaccatcgatggaaagtgtggccccgctgatcgagatgttcccgttgctctcgagcgtgatgcgcgccttgccaaccttgatctcgagccgatccccggcgctgatcgaccaggtcttgccgacaaccgtatttttcgacagaccgacttcctctgcctgagcgagacctactgccgtgttcatcgctccggcaaccgtgacggtataaccggcgccgattgtcagcgccttggccattccgatcgtctcggccgaagcaagtgcgatcaggagattttgccaaccctcgatcgtttcgttccggttgccgccgaccgtcagtgtctcgttgctgccaacgcgttcggtacgatccacgccgatcgtgatggtctcattgttgtcgaccgtctcggttcggtcatggccgacgtgcaccgtctcatcgtgatcgatgttcttctttcgatcgtttcctacccaatgcgactcgtcgtgctcgacctcgaggcgctgatctttctcagcgtgcaaccagacttcctccgaacccttcttgtcctcgaagcgaatggcgttggccgtgttgacgttgcctgttttggtcgagcgcgtgagaatcccgctctgtgtagcattcgcaggcaatccccatggaggcaggttggcggagttatagacgctcgagatgatcaggggtctatccggattaccgtcgaggaaaattacgaccacctcgtcacctatccgcgggatctggatcatcccaaatccgcgaccggcccacggttgcccgacacgtacccagcatgaactgccttgatcgcgcttgcccagccgatcccaatggaattgcaccttcacgcggcccaggttgtccgtgtaaatttcttccccttcgggaccgacgacgacggccgtttgcggaccgatgatcgatgggcgctcgatcgtgaacgccggccgatacggaatcttcttgcggatgcaggtgaaactgcactggtagttcgctgcgccttctccggcctgatagttgttcgttccgctgtgggtgatcgtcgtcagcagaaactgtcgatcctcctgtttggcattgctgtggtcatagtgatcgtcgagttcgaagtattggcatggcgtcagccgccggctcgtgctcgttccgatgaagactttgctgtgtgccgcaagcgcctgcgttctgaagcgcgtcaacgcttctccgcgatcgctgtccgcaaacccatgttcgcccaggtagtcgtagacttcgtacgacggcacttcaccttgattgacttcggttccgcccgaaacaaaccggcgggcgtgcggtgctttgtaatcaaacgtcttcagcccgacactgttggattccagttgccggctcgcctggaacgacgtaacgaccgccagattgtcgagcgcctcgccttttgtgtattgcagctgcggactgcggccgctaatcggcttcgcgctaatcgagttgtccgagatgactagtttgtgaccgtctttcgcgtgctcgaagaagaagaacaggccatcttcttgcatgaggcgctcgacaaattccaagtcggtttcacggtactgcgtgcagtagctgcgattcttcgtcgccttagacaaccggaactcgaacgacgcaatctttccgtagtcccgaaagacttttgaaagaattgcttcggtattctcttcctgaaaaatccggatgtcgcgactgcgcgagagcatcaaagccatggcacgagtgtcgcgctgtagatggtgaagctaccgtcgtggtcgaggtgggtgaagttggctatgtagccgtggaaataccgttcttccgagctcgccagcgcatcggtaagctgtaacgtaatcgtcaccggctgaccgatcaacttcttcagttcaatgttcgagtcttgagaggcgagccgaacgtggaactcaaagttctgagataagccttcggtaccgtgaaaatcgacaagcaccaagtcagatcggcccttcataggcgtctggatggtgaacagccgattgctctgtagcccaaaaacttggaatatctgacagttgcatggcgccctcagaaccctgcatcggagtggcaggatattattcgtcggtggattttaaactgccagacgccgaaaagatcaagttttgcgtttcttgcacctcatatatggggacggatttgtagggaaggtgaatggataacctgttgccccactacgaatacgaggtcggtttactgctccgtggcgcttcggaatttgcgcgacgctatccgaagatcggcgcccgactcgggattgcaaacgggcacggcgatctgcatgtcgaccggatgatccagacgtttgcattgctggccgcgcgtgtcgatgcaaagctcgaggacgcctatccggaattcaccgaatcgctgctggaggtgctgtacccgcagtatctgcgcaccgtgccttcgtgcgcgatcgcgcagtttgatcctacagatctcttcggtcagttgacaacgccgttcacgatgccacgtggcacgctgcttgatgccaacgcggcgccgtaccggtttcaaactatctatgacgtcacgttatccccgttacgagttcactcggtacgctatgccccggctacgcttgtccctgcggctgtccgactcccacccaaggtcactggcatactttcgatcgcgctcgccagcgcgacagcgatggagatcttcgatgaggcaattccgttcggtacagttcgtgttcacctgtccggtgatcgaccgcgcgttgctgcactcaccgatgctatgctgctacgtgctggcgccgcatttgttgaggtcgatcagagcggccggtgggcggaattatctaggataccgatcgaatcggtaggttttggcgagaatgaatgcctattgccgaaagaatcaaccactacatcggatacgtaccaaacgctcatcgagtccttcgcgttccccgaaaaattcgactttgttgacatcgatctaggacgaatgcggcgggccgcacgcacgccagcggcaaagcggctgacgttgcatctcgcaatcctcgacacaccagccgaatccgccgcagcacaggcactgaccgaactcgatgcctcatcctttcggttgtactgcacaccggtggtcaatctgttcaagcgagacgcgattccgatccagttgacaagcgctgatagggcataccccgtcacaccggagccgctggaaaccggctccccgctcgacgtgtactcgatcgatgccgttcatttaggcgatcgcttgcaggctgaacaagagaggagctcgccgtcgaccagtagccacgtacgaacggaagtattgccttaccgggcgttcagccatgctcgctccctgatcccgcgattgcatactgggctgcgtttcgcgatccgtacgcagcaactggaacaacgcgcgcgccactgctgctatcactcgtcggactggagggccattctgctcaactgaaacatccgcaagtcgacgtcgacgtcacggctaccaatggagatttgcccgcccggttgccgatcggtgcacgcgacagcgacctgctgcacgagggcgcggcgttagcatgccccattagattgcttacgcgcccgaccttgccgagcagtctgccgcggggccacgacgcattgtggcggatccttgcgggcatgtcgttgcacccgttcgatctgacgcgaacggggctgaaggcgtttaaagactttctaagactgcacgcgccgcgcgcgagcatcatcgcgcaacggatcatcgatgcgatcaccgacctggaccatcgccccgcgatcagatggatgtcgcccgatggcgcgttcccgtcgttcgtccgcggggtcgagattgtcgtctctctcgatgaagcagcgttgcgcgacgttacgttgcacttgttcgcgcgaatgttggacaggttgtttgccccgtatgctgcgatgaacagctacgtcgaactggttatttgctcctcgcagacggggcgcgaacttcaacgctgtccggcgcgaatcggaacacggccgctgatctagttaatgcagataaccgaccaaaatgcctgcgcccccgccggctatcacgccgacggttgtcccgcccatcaccaagatggcccgcgcatgagcaattgcgttctctgctaaccacaccattgcggggcttgatagcccgagcgcaagctgtgcgggattgatgccgagaagcatggccgtgcctgctttgccgtatccgacgccgacgcctccgtcgagatagaccgtggcccctgaaaatcggacttggagagttccttgccgtcaaacgctggcgccatatatatcaagccggcgctgtcaaaggacttgagagaaccggctcctccgacctcatgtccagcaatctttgggatcttgatctcggggattgagaatcgtggcaacttgatcttcgggattcgaagcccaacgccatacccgatcccgatgccgccgtagtagaaatcgaacagttggccgccaggatccgccaagacgattgtgccacccgaagcaacggctagttcgagactgaccccacctgttgcgccggttttgtaagtccagtcgctatgtctgaaaattgacacgtggccctctcaagtcgtttattttctggatggcaggttcatcagcgagaagacaatgaagccgacgccgaagatcagcgccatcaacgtccaattccaaactgcgccgaatcgatcgatcgtggcggatcgcagaggcgcgtcctcctgatacagcacggtcaccttatcgccgactttcatgccgtagatcatccctccctgcggataggagacacgctggcctgctttggtgacaaattcgacctggggatggctcccgcctgcattcaggctgacaacttctccgggtacggcaatcgccgtctggagaaattcatgagtcgaccacgcgacgaaggccgcgattatgagaaaaccgatccccatcacaatgcctaggatagccttgaccatgagccctctcgatttctttcattcgacacgcggagtttgaccgcagcctgtctgcgctggattttagcccatcgccggctatcaaatcggcgcaggcggtttagtcaacctcatgacgccgctttcgacgcatcttgtctgtagtcgtgatgctgatgaaatggcatcgagcgcaccagtggccacgccggatggaattgggcgtagctagcccacgatggccccttgcgcactcccactccagctttgtcgcactattcacgtagcttgtggagacacacattcctccgcgctcgtacgcatcaggtcgataccaaatcgcttcgcctcatgctggcactccgtgcaccatgctccacgaaagatccgcgcacctaacatttcccattcgtgaccggccttacatcgaaaccgatagtttgccttgcttccttcataaacttgggaaacgcaccgtcatcgccgatgagcgattgcgaaaaatgacagtttctccgtcccggggttttggatagattggccgtaccgcatccgcatcgcctcagggacaccatgaacttcgaagccacccccgatcaacgcgctgccgccgccacctatcgcgccgtcgcgctgcgtcacttcgcgtcgtcgccgcgccgcggcttcgactgggcaacctggcgcgcgctgtccgaagcaggtctgtggcgcacgctcgtcgccggccgcgatgcaggcgcggacgcgtcgttgaacgtgttcatcgccgcgttcgaggcgatcgtgaccgcgacgagatccgtcggcttcgcgatggcgctggcgaatcaggcaaccgtgattcgcgcgctgctgctccacggcacaccggcgcagcgcgaccgcctcctgccggccctgacgtccggcgcggtggccgcgaccgccatttccgaaagaggcaccggcaccgaaatccgtgcactgcagagccgcgtcacgctggacggccaggatggccgcctcgacggtcacaagtacaacatcagccacgccccggacgcggcactgatcctcgtcgccgcgagcgccacgcacgacggtcgccccggtacggcgctggttcttctcgatccgcaacgcgccggcgtgacgcgcaccgcgccccaggaaaccctgggcgtcgccgatctgccgatcggcgacatgacgttcgacggtgtttccgtcggcacggacgatttgctttgcactcccaaggacggattgcgcgtgctgatggacattgcgtcgatgaaccgcgcgttgttcggcctgctgtgcgcggacgtggtcgggccgttcctcgacgacgcactcgcgtacgtcggcgaacgcggcgcgctcggcgtgacgctcgacaagcatcagcatgtccagcggcggctcgtcgacattcatgtcggtgcggagcgctcgcgctggatggcactcgccgcactcgaccagttgagggcgggcgacccgtccgcgctcgccagttgctcgattgcgaaactgggcggcgcccgcgacctgacccaggccgcgctgcacctgctcgcgatctacggcagcgacggttatcgccgcggcccgctcgcgaccttcgttgccgacgcactcgccatgggaacggcgggcggcaccgaagagatgcacgcgcgcaacatcttcagccagatgcagcgacgcgcgactgcctcgcacatgcacgcggcctgagtgctcattttcgtttctcatcccgaaggagtctgccttgaccatccagcccggcctccgtgcccgtgccacgcaccgcgtcgatacgatttcgcttgcagatcaatggggcggcgaagcgcacgcccttgccagcccgatcatgatcatcttcatcgagcagacctgcatgcaggcaaccgatcacctgctcggcgccgacctgatgacggtcggctacaacttcgagatcaagcatctcgctccgacgccgcccgactgggaagtcacggtcgacgccgagctgatctccgtggaaggccggatgatgacctacaaggtgtcggttcgcgatgcggccggcgtcgtcggcgaaggcatccatacacgctgcgcggtcggtcgcgacagttttcacgagcggcttgccgagcgccgcgaccgcgcaccggtcgcgcaatgagcatcactggaggagacaccccgatgcgctcgacgccgctgcacgatttgcgcctgccgctgatcgcatcgccgatgctgatcgccagctaccccgagatggtgctggcgcagtgcaagagcgggatcgtcggcgcctttcccgcgctcaatgcgcgaccgagcgcgcagctcggcgactggatcgatcgcatcgacgaggaactggccgcgcaccgtgccgcccgtccggatgcgtgcgtggggccgtacgcggtcaatcacatctgccatcagaccaacacgcggctcgaagcggacttgcggatctgcatcgaccggcgcacgccgatcctgatcacgagcctgcgcgcgccgccgcgcgaaatcgtcgaagccgtgcacgcctacggcggtgtcgtgctgcacgacgtcacgaccgtacgacacgcggagaaagcgctcgaggccggtgtcgacggcctgatcctggtcgcggccggagcgggcggccatgccggcacgttgtcgccgttcgcgctggtgtcggaggtgcgccgcattcatgacggcttcatcgcgttgtccggcgcgatcgccaccggcgcggccatcgcggcagcgcttgcactaggtgccgactgcgcgtacatgggcacccgcttcctcgcgtctcacgaagccaacgtggcgcagcgctacaaggacacgatcgtcgaggccacggccgccgacatcgtctacaccgatgcgttcagcggcgtgcacggcaactatctgcgccagagcatcgaggccgcgggcatggacgtccgcaacctgccccgcagcgagcacgcacacctcgatttctcgcccgaatccggcgcgcgccagtggcgcgacatctggggcgccggtcagggcgtgggttcgatggacacggtgctgagcgtcgagcagatcgtcgcgcagctcgagatcgagtacggcgtcgcactcgaacgcgtgcgtcacgagtccgcccgcatcggccggcacgcacccgcgcactgaccgggcacccgccttctttcgctacctccacggtaccgtcatgaccctcaccgccaccgacttgcccgctctcgatccggtcgcgctgcaacgcgcgcagatcgatgcaatcgaccaggaactgctcgcgctgatcgcgcgcaggatgcagcacgccgccgcgatcggccagttcaaggcgctcgacggccggacgatccgccagccggcccgggaaacggaaatcgtcgcggggctgtgcgcccggccgcacgggctgctgcaggcgcgccacgtcgcggcgatctggcacacgctgttccgcgtcagccgcgagttgcagcgggtgccgtcggtcgcgttcctcggcccgcccggcacctttaccgagaccgcgatgcagcgctacttcggcgccccgatccgtccacatgcgtgcgacacgctcgaagcgacattcgccgcactggcggccgcgaacgtcgaccatgcggtggtgccgatcgagaattcgaccgaaggcaccgtcacgcgcgcgatcgacctgctggccgacgcgaccgctccagtggtcggcgagatcgtgctgccggtcgcgcactgcctgctgagcgcatccggcacgctcgaaggcgtcgactgcgtgctcggtcatcagcaggcgctggcacagtgccgtgcatggctcgatgcgcatgcgccgcaattgcgccgcgtgcctgtcgcgagcaacgccgcggccgcccgcgaagcagcgagcatgacggattgcgcggcgatcgccggcgaacgggcggccgaccagtacggactgcgtatcgtggcgaacgcgatccaggacgagcccggcaatcgcacgcgctttctcgtcctcggcgggccgccagcagagccgacaggccatgaccgcaccagtcttctgctgcagctcgacgatacgatcggcgcgctcgcaggcgtgttcgatgcattggcgcgccaccgaatctcggtgctgtggctcgacgcgcgtcccggccgcgccgccggatgggcgtaccgcttcttcgtcgacatcgacggccaccaggacgacgcgcatgtccgtgccgccctcggcgacatcaggtcgatcgccgccgacctgcgaatcctcggttcctacccgcgcgcgccgttcgtcgatgccggcgccgttgccgagccgagcgcgacatgagtgccgcgtccgccgataccgccgtcgcgcgccgggtgcgggccatctgtgacggccacgacgatcgcctgctggtcctgctcggggtcgtgccgccgtcgctgcgtcgcgacaccggcgcatggctgcgtgcattgcgcgcggactacgaggacgaactggagttgctgacgcatgtgcagcgcgtggccacgccggacgtcgacgacgacgcgcgggccgcgctgcttcgccggctcggcagactgcggctgccgacggcgttggtcgtcgatacgtccgcgacggcctacggccgctggtgcacgcggaacggcgccaccgcgcacggctggcggctgctggaaaccgcgcgtggcgcggcgcccgtcggcggcgtactcgtgccctggcgcgactgcctcgcggcacccgcgacctcgcgccgcgtgctcgccgatttcggccaggcgtgggccggcatcgatacgagcgtcgccatgctgaccgacgcgctgcttgcgaacgacgtgcaggtcgggggcatcgcgctgggcgatctgctcgcgcaacccggtgccgcgcccgtatcgcctgcaaggatgaccggcgtcctggaccgcctcgccaatacggtgcgcctgcgccgtatcacggcggcgacgcgccggacgcattcgctgcggagccggctgtgacggcagcgcaccatccgcgcatcgcgttgatcggcatgcccggtgcgggcaagacgacgatcggcgcggcgcttgcggcggcactcgaccgcccgttcgcggattccgaccgggagatggagcagcgcttcggcgccccgcttgccatgctgtttccgctgccgacgttccgcgcccgcgaagccggcgtcatcgatgcgctgtcgcaacgcgacacgctgatcctcgccaccggcggcggcgcggtgctgcgcgacgacacgcgcgcgcgcctcaaggcgcgctgccacgtgatctacctggtcagcgacatcgacgcgctgtaccggcgcaccgggcgcgatcccgtgcgcccgctcctgaacgtgcccgatccgcgcgccgtgctggccgagttgcagcggacgcgcgatccgctgtatcgggcctgcgcgcatcgcctgctcgacacgcgcggcgcgtcgatcgacgaaatcgtcgcggcggccctcgccgaatccgcgtccgcctgacggtcgcgcccatgcgcgcggcttcccgctcccggttcccttcccgccccgtcacgggcgctccccactgccatttctgacagttgctcgttgtttgagaatatctaaagatatatttttagatagtctgaattcgtcaaccggactcgtggaaaccgatcatgtccaagtttcttgtctcgactcgaagatggggtccgatcgctacggcagccgtgacggcggccgtcatgaccggttgtgccccgttcggccagcagccggacaaacagaagatcaccccggtcgaacagctcgacccgggcctcgcgcttcacgcggccaagggtcaggccgacgtggacgcgcaatggtggcgcaccttcggcgatccgcagctcgaccgcgtgctggccgacgcgctcgcgggcgcgccgtcgctgaaggcccagcgcgcccgggtcgacgaggcgctcgcgcaagccgacgtcagcgcggcggattccctgccgctgctcggcgcagcggtcagcgcgacgccgacgcggctgccgcgcagctacaccacgccgcccccgccgcaggccactggcaagtcaacgcgcaggcgctgctgaatgcgtcgttcgatctcgacgttgccggccgcctgcgcgcgctgacccgcgccgcgaccctgcgcgccggcgagcagcagtcgctcgagcgcgcggcaaccgtgtcgttgcaggccgcgctcgtcgaaacgtacctgcagctcgcgctcgagctgcaactgctcgacatcgcgaacgatacgctgcgtcagcacgattacctgctgcgcctcacccgccagcgtgaagcggcgggactcgacatgccggtcgcggtcgcgcgtgccggcgagccgctgccgctcgcgcaggccgatgtcgagcggcagcgcgcggccgtcgcgctgctgcgccaccggctcgcggcgctcgtcgggcgcgggcccggttatgcggacacgctcacgccgtcaccgcgcgtgctgcatgccgtcgcgccgttgcccgcgacgctcccggccgcgctcgtcgggcgccggcccgacatcctggccgcccgctatcgcgtcgaggccgcgtcggccgacatcgacgcggcccgcgcggcgttctatccggacatcaacctgatggcgttcgccggcgtgcagagtttcggctttcgcgcgctgcttcacggcagcagcggcacgttcggcgccggccccgcgatcacgctgccgatcttcgaaggcggcaggctgcgagccggcctgcgcgcacagaccgacgcgtacaacgccgccgtcgccgactacgacgacaccgtcgtcaacgcgctcgcccaggtcagcgactcgctcgtgcagctcgacgcgctggccaggcagcgcgacctgaatcgcgatgcgctggcacgcgcgcagcagacctacgacatcgagacgcggcgctaccagaaaggcatttccggctacctggacgtgctgctggccgaaacccggctgcttgaagaccgccggtcggtcgctcgcgccgatacctcacttgccgtcgagcacgtccggctgatcgccgcgctcggtggcgcaacgaaccccggagcccaacaatgaatcgcaccgacaccccgccggccgccgcgccggccgccgcgggcgcggcgtcgcccccgcccgccgaacaggcgctgcgcaccacgcggcgccgctatttccgctggttcttcatcgcgctcgccctggccgcgctggccggcggctactggtgggtcacgtcgcgcggcaccgagacgaccgacgacgcctacgtgacgggcgatgtcgtgcaggtatcgccgcaggtggcgggcacggtcgacacgatcatggtgcagaacgccgaatgggtccgtgccggcgatccgctgttccgcgtcgatccgaccgatgcgaagctcgcgctcgacgacgccgtcgcacagctcgcccatgcggtgcgcgagtaccgcaccgcgcatgccgacacggcgcgcgaggcggcgcagatcctccagcgcaaggccgagctgtcgaaggcctccgacgacctgcagcgacggctcggcctcgcgcaggacggcggcgtatcgcgcgaggacatccgccacgcgcgcgacgcgatgaccagtgcgtccgccgcgctggacgcgcagcaggccgcgtacgacgcatcgcgtgcgcgcgtcgacggcacgtcgatcgactcgaatccgctggtgcgcgccgcggccgcgcgggtgcgcagtgcggcgctcgcactgcgccgcaccgaaatccgcgcgccgctggcggggctcgtgacacgccgtgtcgtgcaggtcgggcaacacgtcacgcccggcgcgccggccatggcgctcgtgccgctcgaccatgtgtgggtcgaggccaacttcaaggaatcgcagctgcgcggcatgcacgccgggcaggccgtcgagcttcgctcggacctgtatggctccgacgtcgtgttccacggccgcatcgaaggcgtcgaggcgggcacgggttcggcattcgcgtcggtgcccgcgcagaatgcgaccggcaactggatcaaggtcgtgcagcgcgtacccgtgcgggtcgcgctcgatcccggcgaattgcgcgcgcacccgctgcgcatcggcctgtcgatgaacgcatcggtcgtgctcggcgacggcgcgcccggcaccgcatcggcctccgtgcgccccgcgccggccgccgcccggcgcccgatcgacgcgacgtcgatcttcgatgacgatgcatcgtccggcgacgccctcgtcaacgacacgatccgcgcgaacgacggcgttgccgtgcgccgcgcgccgggagcctgagcatggcgcccgtcgctcggggtgcggcgccgaaactgccgctggagccgctgcagggcccggctctcgtgctcgtcgcgatcgcgatcagcgtcgccaacttcatgcagacgctcgacctgacgatcgccaacgtcgcggtaccgaccatcgccggcgatctcggcgtcgcgcccgacatgggcacctggatgctgacgtcgttcgcgacgccgctcgcgatcacgctgccgctgaccggctggctcgcgcagcgcttcggccaggtgcggctgttccgggtctcggtcgtgctgttcgtcctgacctcgatcctgtgcggcctcgcaccgaatttcgaatcgctgctgctgttccgcgcgctgcagggcgcggcctccgggccgatcaccgcgctctcgcaggcgctgctgctggccgtgtttccggccgcgcgccgcaacgtcgcgctgtcggtctggcagaccaccacgttcgtcgcgcccgtgctcggcccgatcgccggcggctggatcaccgacaacctctcgtggccttacatcttctacgtcaacgtgccgacgggggcgctggtcctgctcgtgctgacccgcttcctcggccggcgcgacaacccgacccgccaccttcccgtcgatttcgtcggcctgctgctgctcgccgccgcattcggctcgctgcaactgatgctcgaccgcggccagaacctcgactggttcgcggcggtcgagatccgcgcgctcgccgtgctctgcgtcgtgtcgttcgtcgcgctggtcctctgggagctgaccgacgcgcatccgatcgtcgacctgcggctgttcgcggatcgcggcttcaccgcgggaacgatcgcggtgacggtcggcttcggcgtctattacggcgcgctcgtgctggtgccgctctggttgcagaccgagcagggctacacggcaacctgggccggcatcgccaccgcgccgctcggcatcgcgggcatcgtgatcgcgccgttgatcgggcgcatccaggggcgcaccgacccgcgccacctcgcgaccgtggcgctggtcggctggggcgcggcgtcgttctggcgcatgggcttcaataccgacgtgacgctcgacgacatcgcggccaactcgctgctgatgggcgcggccaccgcgtttttcatcaccccgctcgtgtcgctgtcgatcgccgggttgccgcgcgaaaggctgccggcggcgtcgggcgtgcagaatgcgctgcgccggatcggcaccagcgtcgccacctccgtcgcgccgacctatttcgagcggcgctcgcgcgttcacaacacatacctcgtcgatcgcatcacgccgttcgatccggccgccggcgactggctcgcccggctcgaacatgcgggcatgtcaccggccggcgcgctcgcgtcggtcagccgctcgatcgacgtgcaagcccacatgctcgcgctcaacgatttctcgttcggttgcctgctgctgttcggcgcgaccctgctgaccgtctggtccatccgctaccggcgtccgtgacgccgatcaaccggcccttccgatgaacgcccccgacctccaaaacgtcgtcgcacccgacatcgccccggcccgcacggcccggctcatctgtttcggcgtctttctcggcgcgctgaccttcggcctcctgctgcccgtcgtgccgctgtacgtgcacgacacgctcggcttcggcacgctcgtcgtcggcacggcggtcggcgcgcaattcctcgccaccgtgctcacgcggagcatcgcgggccgccgcgccgatcatcgtggcgcgaagcgcacgatgtgcgcggggctcgtgtcgtgcgtcgtcgcgggcggcgtctacgtcgcgagcgccacggcgccggccggcccgggcgcacgtctcgcgctgctggttgccgcgcggctgctgtccgggctcggcgaaagccagctcgtcaccggggcgctcgcgtggggcatcggcacgctcggcgcgacccgctcgggccgcgtgctctcgtggacgggcatggccctctacggcgcgatcgcgctcggcgcgccatgcggaatggcgctcgcgcgcgccggcgggctggcggcggtggccggcgccacgatcgtcctgccctgcatcgcactcgcgctcgtcgcttcgctgcccgccgtcgcgccgcagccgggcctgcgggtgccgctgtcccgcgtgctgcgaatcatcgcgcggcccggatgcagcctcgcgctgcagggcgtcggtttcgcggcgatcggcgcgttcgtgacgctgctgttccaggcgcgcggatgggaaggcgcgggcctcgcgctcagttgcttcggcggcgccttcgtcctcgtccgcgtcctgttcggccatctgcccgaccggttcggcggttatccggtcgcgctcgccgcgctcgcggtcgaggcgatcggccagcttctcctgtgggcggcgccggtttccggcgtcgcgctcgtcggcgcgaccgtgtccggcctcggctgttcgctggtctttcccgcgctcggtgtcgccaccctccggcacgtgccggcgcaggcacgcggcaccgccctcggcggcttcacggcgttccaggacgtcgcctatgcgtgcaccggcccgctcgcgggctgggtcgtcgcgcgtaccgactacccgtccgccttcgccgtcggcgcgtgtgccgcattcgccggcgccctgctgacagcgtggctgatgcacgccgaccggtcgccccgtgagccccggcggacggcgggcgcatgccctgccgtccgccgcccgtatccgacaccctcgcggcgcccgcgcggcgccatcctgcagtccttcacgcttctacaaggagtaccgatcatggaataccgaaccctcggcggaaccggcttcaaggtccccgttctgagtctcggcaccgcgacgttcggcggcggcaacgcattcttcagggaatggggcagcacggacgccaccggcgcgcgcgagctcgtcgacatcgcgctcgacgccggcatctcgatgttcgacagcgcggacgtctattccgacggactcgccgaagagttgctcggccaggcgatcgccggccggcgcgatcgcgtgatcgtgtcgacgaagggcacgttccggctcggcgaaggcccgaatgacgtcgggtcgtcgcgccatcatctcgccaatgccattcacggcagcctcaagcggctcggcaccgactacatcgacgtgtaccagctgcatggattcgatgcccagacacgcgtcgaggaaaccctgcgcacgctcgacgatttcgtgcgcgccggcaagatccgcgtgatcggctgctcgaacttctccggctggcacctgatgaagtcgctcgcggccgccgatcgcgacgggctcacgcggcatgccgtgcaccaggtctactattcgctgatcggccgcgactacgaaacggagctgatgccgctcgcgctcgaccagcaggtgtccgcgatcgtctggagcccgctcggatgggggcggctgaccggcctgatcggacggggccgaccgttgccggagacgagccggctgcacaagaccgccaacgagggccgcccgtcacggatgccctgctgcaccacgtcgtcgatgcgctcgacgagatcgccgccgaaaccggcaagtcggtcgcgcaggtcgcactcaactggttgctgcggcggcccaccgtcgcgaacgtgatcatcggcgcccgcaacgccacgcaactgcgcgagaacgcgcaggcggccagctgggccttgacacccgaccaggtgaagcggctcgatgccgccagtacgacgcaactgccctacccgtactggcaccagcgcggcttcgagcgcaacccggcaccggtctaatacggtgcctgcgcgtgcggcatcggcggcgaccgatgcgacggtaccgcacgcgtcgccgcggcctgcatgcgcgcggcgagcggcgacgcgccgaccagccagtccagctcgacgggcaacggcggcagcgcgggcgacgcgtgcgcggtcagcgcatcgtagccgaacacccagtccggctcggtcgggccatgcatgaaggtattcgcggcggacacgcgatgcacttcgccgagtcgcgcgacccggcactgcgcataggtcgagaacgcactcgccgcgttcgacgagccgatgagcgcacgcagcaggatcgtcgcgtcctcgagcgccatggccgcgccctgcgacatgaacgggcgcatcggatgacaggcgtcaccgatcagcacgacgcgctcgttgccgaactcgaactgcggcgaacgttcgaacaacgcccacttcatgaccgactcgcgtggcgcgcgtgccagcatgtgacgcacggccggatgaaaatccgcgaaaatcgcctgcatctcgtcgacgtcgcccggcatcgacgaagcctgcgtgggccactcggcctgcggtgtcatcgcggcgaaatagaattcgcggcgcgcgcgatcgagccagtacgacagcacgaatttccggtcgccccaccacttggtcagatcctcgaccgcgagttcgcccagcagcgcgcgcggatacgccccgcgaaacgcgacctgcccggagaattccggcgcctcgaatccgcgcagcgcctcgcgcacgcgcgagcgcaggccgtctgccccgatcaccagatcggccgtttcgctcgaaccgtcctcgaacgtcagcctgatcgcgtcgcccgccgggtcgaggccggcgagacgcttgccccacgcgatcgtcccgggcgccaccgcccccaacagcgcggcatgcaggtcgccgcgcttgagcgtcacgaacgtcgcgccgaagcggccgatcgcgtgttcgccgagcggcagccgatacagcagctcaccgtcggccgcctggcggttggcgaacgcatcgggttcctggcccgcccacagggcctggcgatgcacgccgagcagccgcatcacccgcatcaggttcgggctcaggtgaatgccggcgcccacccgggcaaacgccggcgcctgctcgaacaggcgcacgtcatggccgatccgttgcagcatcgcgccgagcgcgcacccgccgatacccgcgcccacgatcgcgatgcgcgccgccgaagtcgtcccggtcatccctgctctcccacggttgccgccggtgccgcgccctgtacgatgatgccgatcgtgcgtgcggtgcgttcgcgaatatcccgcgcacgccgatagccgtcggactcgtaccacgcctttgcgcggtcgatcgaatcgaattcgagcaccacgacgcgccgaggcgaccacgcgccttcgagcgttgccgcctcgccgccgcgcaccaggaaacgcccgccgaattcagcgacggtcggcgcgccgatctcgcggtactcctcataaccgcgtgcgtcgtgaacatcgatgtcaaacacgatatatgccgtcatgtcttccccacttggtctcgcgggccgcggccgagcgcggccccggtgtcacaggctcccgagcgcgatgctgtgcgtgtcggccgcatcgagccgcagctgcctcgcgcgctgatattcgtcggagccgtgccagcggcgcgccgcgtcgagatcgtcgaactccagcacgaccaggcgccgcggcgtccattcgccttcaagcacgaccacgtcgtcgctgcgtgcgagcacgcggccgccgtgcgcggcgatcgtcggcacaccgagcttccggtattcggcaaatcgcacttcgtcgtatacgtcgacatccaccaccacataggcactcatgtccgctctcccgttgatgcatccgcttcgtcatgcgcgacttcggtatcgaatcgcacgaacacccggcccgcctcgatcttcaccgggaacgtcttcacgcaagccgtaaccggcgcgcacagcgcggcaccggtacgcacgctgaagcgcccctgatgcagcgggcactcgatttcgtcatcgagcagaaaaccgtcgctcaggcgcgcctcgccgtgcgtgcactggttgtcggtcgcgaagatctcgtcgtcgaccgcgaacagcgcaatgtcgcgcccgccgacgatcacgcccgtcaacccctcctcgcgtaccgcggccgtatcgaccgcataggtccattccgtcgtcacgctgcctcctcagatcggatagatgatcgaattcggcaccatctcgctgtcgtacacgcagatgcgcgactcgaaacgcagcccgtgcggcgtgcggcgtatccggtcgagataacgaccggtgttgtacacgtcgctcatctgctcgctcttggtacgcagcaccgcgtagttcgtctcggcctcgatgaccgattcgtcgagatacgtgatgagcggcgtgccgatcaggtggcgctggtaatacgggtcgtagaacagcgtctccttgatgccgtacacgcgatccttcagcatcccttgctctcgaacgcgagcagcgcaagcggaaagtcgcgttcatggttctcgcgcggcaacagctgatacgtgcagtcctcctcgaagaattccggccacgcgtcccagtcgccgcgatccagtgcggacgcgtagcgcgcgttcaggtccacgagcccgtagaaatcggcgaaggtcgccgcaaccgttccggtgccgcgcgtcgcgggccgtgcgtcggccaatgcggatgaaatcgtcattcatgcctccatcacgtggcgccagtactggtacatgccgcgcacgagcgtttcgctgaccatgtggtcggtgcgctcgtcgacgtcgcggccgccgagctcgttgtatacgttgccgtgctggatctgctcgaagctctgctgcacgcactcgatcacttcgccgtcgtccgccgaaacgaagccggccggcccgaacaggttggcctggcgcagccgccggcgcgtcatgtcctcgtcgtccgtctcgaatccgaagtgcgtccagacgtaatcgaacacgccggggctgaccgggcggatgcgccgggtcgacagcgcattcacctgctgctggatgatcacgctcggcatcaacgtcaacatcacgacggtcggctcgccccaccacggctcgtgcacgacgtcgaggaaacggtcgtcgttcagcgtcatgcgctccttgaagctcgtcacgttgtgcgtgacctcgccgccgcccccgccgctgcggatcgagatcatcgcgccgtgacggtgatgcgcgtcggtgaccagctgggccggattgtccgcgcgccacagcccgaagttgacgaaccaggtgtgcagcagccccgcgtgataggggtccttgatgttctccaccatcagcttccagttgctcggcacgcgctggcgcgtataaccgagcacggtcagcttcggcccgtggaacaggcggtcgtaatagcgcaggatgtcgggaccgaggaaatcctcgaacgactcgacgtcctggtcgaacgacgcgaacaccgcgccgccgcgcgtcgacacgcgcagccgccgcaacgcgtgattcttcggatcgaaatccggcggcatgccgccgttgatcttgccgctctgccgtacgccgcgccggaacggcacgccgaccaggttgcccttcaggtcgtagttccattggtgatacgggcagtggaaatccttcgcgttccccgcgcgttcacgacagaactgcatgccgcgatgcgcgcaggcgttctcgaacacgaccacctcgccgtcctcggtgcgcgtcatcacgaccgaacgctcgccgacttcggtgcgctggaaatcgccgggagacggcacttccgcctcgaggccgatgtaacaccagtgtttcgaatagaacaaacgctccagttcgcgctggtaaagcgcatcgctcgtataggcttcgaacggtgtccggcttgcgccgtccccttccagtcgagcgcgtgtgcgatatcgatgggtgagttcaagaaagctcctttcagtaagaaatggcttgtacggtgccggccggaacacccggtaccagaaagccgactcgggaccgccgccgcgacgcgaccgcggcggcgaacagctcgatcagtgcaaccgtgtcctcccagccgagacaggcgtccgtcacgctctgcccgtaggtcagtgcccggccgggcacgatgtcctgccgcccctcgacgagaaacgactcgaccatcacgccggcaatcgcgcgctgcccgtcgcgcagctgcccggccacgttctcgcatacggcgatttgggcgcgcgtctgctttccgctgttgccgtgactcgcatcgatcacgacgtgcggcggcaactgcgcatcgcgcagcgccgcacaggcggccgtcacgctgacgtcgtcgtagttcggcacgcgcccgccgcgcagcacgatgtgcgtattcggattgccctgcgtggacgcgacctcgaggccgccttcgtcacgcggacggagatagtgatgcgctgcccgcgacgtgcgaaccgcgtcgatcgcgatcttcacgttgccgtcggtgccgttcttgaagccgatcggcgcatcgaggccggatgcgatctgccggtgaatctgcgactcggtcgtgcgtgcgccgatcgcaccccaggacaccagatcgtcgaggtagggcgccgtgagcggatcgagaaactcggtcgcgaccggcatgccgagtgcgttgacgtcgagcagcaggcgacgcgcaagacgcagcccgtcgtcgacgcgatagcttccgtcgagccgcgggtcgttgatcaaccccttccagccgaccgtggtgcgcggcttttcgaagtacgtgcgcatcacgacctcgagcgtatcggcgtaacgcgcccgcagcggcgcgagccgacgcgcgaattcgagcgcggcgtccgtgtcgtgaatcgagcacggcccgacgatcaacgcgaggcgatcgtccctgcccgcgaggatgcgggcgagtgcgcgctgggcgccacgtaccacgcgagtggtcgcggcgtcggcatgcaactcgccgcgcagttgcattgccccggtgaccgccgccgtccctttcagatgaggctgttccacttgactctccgatttcgattcgacaatacgaaactcacgggggtcaattaaagctttatcaaattcgattcgatactgtcatttatctcagtcgccaatcgaattcctcaatctgccatttttacagtatctaaaaccatccgattcaatttattttcatcgcgaggacatgcgccattgcacctcgcactctcacatggagatacacatgacgaaaaatcattatgaaactgaaattacagttaaataccgggagacggacggactcgggcatgtcagcagcccggtttattacgattaccttcagcacgcgtatctgacgttcatgcacgacctgctggagctgccgtattcggagaagttgccgcacatcatggtcaagacgtcgtgcgagtacctgaagcccgcgcagtacggggatacgatcacggtgcgcagcagcattacccgtttcggctcgaagagcttcgaactcgagcacctgatgatgcgggacaacggcgcggccggcgacgacgcgatcgttgcccgcgcgcagtcgacgcacgtgatgttcgactatgcgagcaatgcgacgatgccggttcccgaagagttcaaggcgcgcgtgctggcgttccagggcgcgatctgacaaacggcttccggggcgggcgccccgggtcctttctaaacgaatacgatcaggcccatcagcacggctttcacgaccgcgtttgtcttgttcgaagcgtccagcttggcaatggaacgtgaaatgtgaaaattgatcgtacgttcggtcaatccgagaatcatgcctatctcataggcagtcttcccttcggctgcccatttcaatacttcacactctctcgtgctcaacgcgaccgcagtgggggtgtcatgttcaatgccaaccgagtcattctaatctccagaacaattaaccatgctggccgactcggcgcacgcccatcctgcgaagcgtgaatcatcctgttcagccctcgaaagcgcaaacgacagtgcttggcgccaaagcgccagcctgtttctttatttattaagtcagtaatgcacgcgaatcggccatgtgccgctcgcgtacctcgagatcattatcagcaacgatcaggcaacaatcacgaatcaaggtgcattgagcgaaacaatgcaatacggattaattacgccggacgcagcaatcggacaaggttgagcataccgagttgcaatcgcgcgcggaagatgcgtcaggctcaatgtattcatgcagttgacgcgcgcgaacgtgacgtgtgcaccgtcatggttcaggtgcgccgacatcgtacaacgacgacgcctgggtcgcgcagacacgtcgcaggcaactgcgcagccagcgatgcgcggggtcgttatcgaagcgcggatgccatatctgcgaaaccgtcaacgtggcagtcagcaccggcaacgggaagctgaacattcccccgcgatttcgcggtctgccgctccggaacattggcgatcaaatccgaatcgcgcgccagggacaatgcggcgggaaaaccggacacgatcgccgcgacggttcgctgcagccccagcgtatcaagtacgttgtcgatgggaccgctgagctgcccccgccgcgacacgctgatatggccgaacgatgcatatcgctgcggcgtgacctcctcccgcgcaagcgggtgaccggcccgaacgacgccgatgaagcggtcgcgaaacaacgcctgcacacgcaattcggggcccgtatggcccaccacgccgatttcgagatcgacggcccccatgcgcaacgcctcgacactcttgtccggcttcggcgcgaagcgcagccgaacgttcggcgcggtttccatcaccagcgcgagcagttcggccgcgaacgtatcgacgaacccttcgttggcacggatcgtaaacgtgcgctcgagcccgccgaggtccgcgttcttgcatggacaaaggacagcctgcgccccttccacgagcgcgcgaacctggacccgcagttcaagcgcatgaggcgtcggcaccagatcgcgtccggccctgacgagcagcggatcacccgtcgtggccctcaggcgggccagggaccggctcaatgccgacgggctgaggccgagcgtctccgcggcccgcgcgacgctgttctcggacagcaaggcatccagaacaatcaagagattgaggtcaggtgcattcatcttgttcaactcgtgccgatcgggacccggcctggattgacgattaacgggaaccgcgaattcgacgtgatatccgcgcagcgcacgatgacggacaaccgcgccggtcgatcgccggcaacggcgttccctccggcatcgtgcgccggaatacgtgaagcgagacggcccgtttgcgcgatgtcattctgtttccggattgtgcaccgcacgcgattcgatctcaaccgccattcgacgtcgccgcctgtccatatcggccgcagacaccgggtgacggcaaggcaagcaggaacctgtcgtcacgggtcgacgcggtgcgcctgcgttcggccgatgcggtgccctgctggcggccgggaatcggccggccacgcaaatcgaacggcatcccgaacgcgatctcgcggtattccggctacctgcatcggccgcgcttcgcggacgcgcgtcgccacgctacttcggcttgtcgcccatcggattccgcaaccgggcccgctgtcgacgcgcgcacgagttgcacacgacgacgtcgcgattcatcagcgccacgagggttgggtcacgcgcgtatcgcaatcgccgcgccccctgcgcgatctgtcgatgctcgtgcgtgtactcgaggcggccgagcgcgggaacggaccgcgcacgtggcgttaccggtcatgagaggaaccccggttcgcccgcgtcgaatgcccgggttcggcacccgccggcgcggaagcggcagaagcagccaacggcgcgttcatgtacgccgggacagccttctttccctgtcggacgcccggcggcggcgccgtcgggcgctgctccatgtcggccagcatctgcccgcacggcaacgagcgactgcggcccggctgcagcaacgcgagcagactggcgagcggattcagcaagcccagcccgatcgcggcaccgccacgcgcgatcagtgcgcccgccttcaccccgacgtgcggttgcttgaaggacccggtgacgtacagcggcgagcgtagcgatatcacccggaagcccttggtatggggatggatcgtcaggttcatggtctcgtcccgcaggttcacgttgccatccatgccgatcaccgcatcctcggtgtcgagcgcgaatacgcgcgagtccagcacgccgttggtgaccacgaagtcggccacaccgcagttgatcttgacgtcgcgcgtgccgaacaatttctcgtacaccacgtttgcaacgttcagccccgcggcttccatcagcaagagactcaccgtgccgtcggtcaccaatgtcttcacttccccgttggaagtcgcggcgagtgccgccggcgaattgccggtggccgacagcgcggcatcgccgttgacctcgccgagcgccgtttgcatcaccggaaatgtcgggaacagttgcttgagtttcagatgtctcgcctgcagcgagaaccgccccttgagcggcatgccgctgccgtccaggtggatattcgaagcaagcgtgcccccgcgacgccgaagttcagcgggttgagcgtcagcacgccgtcatgcaacacgacgtgggtcgacaggtcggtgatcggcaggctcgcggtcttgacgatgcgccgcccggtcaatcgaacgtcggcgtcgatcttcttccagcggtccgtgcggaatgcctcgaccggcaatgccttgttcgcgggctgcgcgacggcggcgccccgccgcgccttgctggcattcgtgtcggcgccgatgagcggcgcaaggtcggaaaactgcagcagcctcgacaccagggtaccggacaagagcggcctcggttcgcgcgaaacgtacaccaacgagccgttgatgtcgctgccgccgacgcgtcccgtgaagtcctcgtacttgaagacgttgccggacgcccggaattggccgaccagtcggccgtcggtcgcatacggagcggtttcgggaagggtgaggcccgtgacgtcatacagcttggccatgctggtgcccgcgagccacagtcgaagatcgaccgccgccaggtgagccggatcggtcagcgtgccgacgagcgccaggtgcgtatcgccgaagcgcaagtcggcttgaaccggaaacgggtgttgcgcgccctgcacctccagcacattgccgatcttgcccgtgccggcgaccgcgcccttcttgtaggtccccttgacggtccaaccgatcgcgtacgtgccgacgccggcagatgccgcgggtgccgcgggtgctgcgcccgtcgatgcgctcgttgtcgccgaagccgttgcgcccgacgcggccactgcgggcgcactcgatgccatcgacgggcctgatgcagccggggctattgtggtgcgagatgtcgtcgccgcggcatgtgaagcagcggccaacgcttgcgacgccgcggccgatgcgcgggacgccgcctcggcacccgacgcaggcaccaccggttgcgccgggccggcgcgcgcctgggccgcgagctttttctgacctgccggcccgacggtccgcaccgattcgtgttgcgccaacgcctcctgctgtttcagcaccgcgccgaacgggatcggctggccaagcgtgtcgaccacggcgctcagatcgaattgcttttgctgatcgtagtagccgagacgaccctgggcaaacgcgacctgatgcaggtcgagcgtccatcggcccggctgcgcggggctcctgagcttgagcgtccagttgactcgcccgtccctgatgcgctcgaggtcgacggacggattgaccaggtcgattgccggaatcacgatgcggcgtgccatcagcggcagcgcctcgacttcgaagctgatcatgtccagcgcgacgaaatacttcgtgcgcgcccaatcgggattggcgatcgtgacatcgcgtgcactgaatcgcggccacggcacccatgcgcgccagccttgctcgctcaccggccgacgccaatcgatacgcaaatcgccgttgatcgcgaactgacgtccgatcgcgtccgacaccttgtcatcgatccacggccgggctcgattccagtcgaacgtgacaatgaagatgaccagcgcggcaagcgccagggtgacaatgacggcaagccacgcggccaccttgccgacggtgtggccaatgtgcattgctccctccccgagtttgctgcaccgtatccagcaattcgtgttcctgaatacggggccgcccgccaggtagcgtgcgtgccttcgagatggggttcgtacgacttttcaggcgtcgatcttcgcagtaatgttccggatcgactgcactacctgccctcgctgcgtaacgccggcaagctcgttgagcgagagaagcggacgcctgctgcagtgcttcctgcatccgcgggatgcgatcgggaggatcaatggatcgtcgccatttcctcaagtcgtcggcctttttaccattgcggctgccgccgctgctgtcccgtacgacgtttcaccagcgggcctgccgggcagcaccgcgcgcaaaaaccagtcaatttccgcaaggtgtcgcaagcggcgatccgcgcgatcgctccatcgtgttctggacacgctgcgtgccggtaccgagcgacgtccggcacgatgcaagaagtgccgcgcgcgcggtaccgctacggctcgaagtatcgacgctgccggatttctcgacgctcgtcgccagcgtaccgctgagggcgctggccatctacgacttcaccgtgcgcgcgaaggtgacggcgctctcgccgaagacgacctaccactacaggttcgtcgccagcggcgacgtcagcatgaccggtgtcgcgcgcacggcaccggaggccggcgaggccaacgaacaggttcgcttcgcgtggctcacctgtcaggactggagcgtcaaccactggcaagcgatgacgctgatggccgccgaacgcgatctcgatttcgtcgtgcacgtgggtgactatatctatgaaacggtcgggacctctccccggccaggccgagccggcacattctccgctgcatctgcccgacggcaagcggctcgcggacggccgcgcgtatgccgacacgctcgacgactaccggacgctctatcgcacctatcgtaccgattcgcgcttgcagacactgcaccagcgcctgccgatgatcgcgatctgggacgaccacgaattttccgacgattgctggcaggatcatcaggtctacaccaacgaggagcaacaggaaacccggcggcggcgcaacgccagtcgcgcgtgggcagagtacatgccggtggattggggcgacgtgcgcttcgagccggacgatccgtcgtacacgaacattcgcatctaccgcgattttcgtttcggcatgctgatgcatctggtgatgacggacgagcggctgtatcgcgacgaccatgtcgtgagcgaatccgctatcgcgcgcgcgcacgggcacgacccggtgcacggtgacgacgcggccggctcgcgctacttcgtcaagcaggatggactgctacgcgacgaggcgcgtcttgcccggcagttgggccgcccgccgtcgctgctcggtccggaacagacgcaatggtggaaagccgcgatgaagggttcgccggcaacctggaaggtatggggcaacgaggtgatgttgaaccgtctgtggttcgtgatgccgggtgcacccaagacaccggggcccgcctcgtggtcgattgcgacgcatgggacggttatcccgcgcacaagcacgaactgctcgcctacttgagggagcacgggatccataacgtcgtcgcgatcaccggagacctgcatgcatttcaatgcggcatcgtgcgggacgatcccgatcccgcgacggggtgccggtcatcgtcgatttcgtctgcgccggcatcagcagcatgtcgttctattcctacctgaaggcggcatggaacggcacaccgctcgcgtccatcgcggcgacgcctgccaggctcgaccgcttcctgatggcgaacaaccccgatctgtgccacgccgaccacgacgcgcagggttacgcgtcggccacggtcacgccggactccttttccgtcacgttcaacaagatgaagccgttgaacccggacggcgccgcgcccgcggatgcactgctgggccgcacgcgattgaccgtgcccagggattcagtcgaggtacgcgtcgagcacatgtaggttccgacgcgccgccgtttcccggcggcattgcgcgtctccggaaactcgagcaagcggccctgtgcgctcatgcacagggccgttccacgcggcgcgtcagtgtaaatgtccgccgaaaagcccgagcaaccctatgatgatcaggtagagcgcaacgatgtaattcagcaagcgcggtaccaccagaatgagaatcccggcgatcagcgaaaccaatgggctccagttcgtgaattcgtgcatggtgcggcctcctgacagtggatcgcgaaatcggatgtgcgtcggtgcgacgttgatccacgtagcggagcgatttccatgcctgactcgacgcgtgccgcgtcgagccttcgaatcggcgagccttctcttccggagccgtgcagatcgctcaatcggcgggggcagcttcgctgacaggtccggaaagtggagttcgccttcgtaggtctcggcaccggctgcgagtatcgccttcacacgcgcctgtatcgcttcgttggccacgcaaagatcggcctcgtgcgcttccaccagcaagccttcggagaaggaaacgtcggaccccatgtccacggaccgcttcaggtgtgcaatcgtggagggcgggaacgtcgcgatgcggcgcgccagcttgtccacgaacgggcccagttccctggccggcaatgcacgattgatatagccgtagtggtcggccagctccgcggagaagtcttccccggccagcagtacctcgagggcgcgggcgcgtcccatccgccgcggcaggcgctgcgtgttgccaccgcccgggacgagcccgcacacgacctccggctgaccgaacacggcttcgccaatcgcggcgaaacacatgtccgcggccagcgcaatttcgcagccgccgccgcgggcgatcccttcgaccttcgcgatgacggccttgggcatgttgcgcaagcgctcgccaagcatctgtgtcaggcggaaggtgcgcgtattcgaagtcgttttcggcgccgagccgacacgatgcaggcccgagtgagcgatgaagaacttcggcacggcgctctgcaggacaacgacacgtacgctcgcatcctgttccagcagccgggtcagcgagtcgaactcctccgagagaacctcgtcgagcagattcagcggcggatagtccagggtaaccgtggcgacgccgctatcgcgggtcacccggatatgtttgtaatcggcatagcttccgcctccccctgtgatggcgcggacggttggggagcagcgcccccttccgaagacgcgagcaacacaccgggcgcgagtgtggcggcaccgattgactggacgaaggtacgtcgagagatagtcgacatggcagactcctgggttggtttcatctcgcctcggcagagccgcgcccggctcgcgatccgcggcggcgtcaagtaacgcagttgcaatcccctggcgcggcggtccccatgtcactgcgcatggcaatgactgcgccggcaatccggcgtcgttgagcggcattcgtcagttcgaaaagcaagcttcgccgacgtcatgatccgcgtcccgtcggggcctttgcaagaatcctccctaagtgggggcgcccgatcgacctcgcgcggcagcgcggagcgggtcgatcctgcacgccctccccgaacaggggctgccttcgcgccgggccatgggtacttttggcggcatgaccccttcgacacatgatccggcgcgcgtctccttcctgggcatccgcccgactcatgcctgttgaagtgcgtaccggcacgctgtcgctgcagggtcggcagtccctcgcggccgcgcaccgacgacaccacggaatgatccgccccatccatgaacaaaagccaatcatccggcgacaagccggcgcctgagtcaggccggcgtgttttcctcaaacgcgtcgccatcgttcccgccgccgtcgcgataggcgggtgccattcgggcgacgacgcatcgccggcaccgacggcgacgcaaaatgccggcagcggcgttcggctcgacacctatcgtccggtgttcttcacgcccgaagaatggcacttcgtgctcgcggcggtggatcgcctgatcccgcacgacgacgagggcccggcgcgctcgacctgaacgttcccgtcttcatcgaccggcaactggaaaccggttacggctacgcggcgcactggtacatgcagggtccgtttcgcgcggcctcccgctgttcggctatcagtcgaggctcacgccgcgcgagctgtatcgggccgggatccaggcgacgaacgcacgctgcatgcgcgagttcgccggcaagcgctttgccgaactccccgtcgcggaacaaaccggcgtgctcgcacgcctggagtccggcgcgatggcattcgacgcgatctcctcggcggatttcttcgcgtttctgctggagaacacccgcgaaggctatctgtcggacccgatacacggcggcaacaaggaaatgggcagctggaaaatgatcggctttcccggggccagggctgacttcctcgactgggtcgggaccggcaagcgctacccgtacgggcccgtcagcatcgaaggtcaacagggttgagacgcatatgccgcaaatcacgaagccggaagtggatgccgtcctcgtcgggatgggttggacaggttcgatcatggggatggagctggccgaggccggcctgaccgtagtcggcctggagcgcggcgcaaaccgcgatacgagccccgagttcgcgtaccccgccatcgccgacgagctcgcctacattcagcggcgcaagctgatgcagaatcttgcgcacgagacggtcacgatccggcatgcaccgaacgaagacgccttgccctaccggcagctcggcgcattcctgctgggtaccggggtaggcggctcgggcgtgcactggaacggcacgacctggcgtgccaacgccgccgacctcaagatccgctcgcactacgagcagcgatatggcgccgggttcattcccggcgacatgacgatccaggactggccttactcactggacgaactcgaaccgtacttcgagcgcctcgaggccgtgatgggcacgtcgggcaaggcaggcaatctgcgcggccggatcgtcgacggcgggaatcccttcgaggccatgcgccggcgcgactatccgtgcccgccgctcgccgacaattatccggcgacgctgttccggaacgcggcgcgcgacgccggttttcatccctttccgatacccgcgtccaatgcgtcgatcgcctatcagaacccgtacgggatgcagctcggcccgtgcaacttctgcggctattgcgaaggcttcggctgctacatgtatgcgaaggcatcgccgcaagcctgcatcctgcccgccttgctggccaaacccaatttcgagttgcgcgaccgatcccatgtgacgcgtgtgcagctcgattcggacggcaagcgcgcgaccggcgtgacctatctcgatgcgcagggccgggaagtgtttcagccggcgcgcatcgtcgtgctgtgcgcgttccagatgcacaacgtgcgcctgctgctgttgtccgggatcggcacgccgtacgatccggcgacgggaacgggaaccgtcggcaggaacttcgcctatcagaagaacagcgcggtctcgctgttcttcgacaaggacgtccacatcgatccgttcatcggcgccggctccggcggccaggcattcgacgacttcaatgcggaccacttcgatcattccgccgcggggttcgtcggcggtgcctatatcagcgcgatggtcaccggcggccgtccgatcggacagaccctgctgccggaaggcacgcccaaatggggctcggcgtggaagaaggcgctcaaggacaactacctgcattcgttttccatcggtacggcggggtcggtcatgtcttaccgcacgaactacctggatctcgatccgacctatcgcgacgcatacggcctcccgctgctgcgcatgacgttcgactggcacgacaacgagatgcgcatgacgcgcttcgtcaccggcaaggccgagcaggtcgcgcgtgcgatgaagccgaaatcgatgtcggtccacgccgggaagatcggcgatcacttcgacatgcggccgtaccagaccacgcatacgacgggcggcgcggtctgcggggatcgtccggacacgagcgtcgtgaacaagtacctgcaatcgtgggacgtccacaacgtattcgtgacgggagcctgcgcgtttccgcaaaactgggcctacaacccgacaggcatggtcggcgcgcaagcgtatttctcggcgcgcgcgattcgcgagcagtacctgaagaatcccggtccgctgctaccgacataggaaaagcaatgggtgagcgatacaagaaactggccggaatctcattcgggctgctatgtaccttcgtcacgctggctacgtggttgcaaccggccgacgcgaacgcgcaggatgccgggcagatcgcgcgcggcgcctatctggcgcgcgtcggcgattgcgtggcatgccacacgtcgcgccgcgaccagccgtttgccggcgggctgccgatggaaacgccattcggtacgatctattcgacgaacatcacgcccgataccacgcacgggatcggccgctacagctacgacgatttcgcggccgcgctgcgcaaaggcgtcgcgaaggacgggcacctgctctacccggccatgccgtatccatcgttctcgaaggtcagcgacgccgacacccgtgcactctatgcgtacttcatgcacggcgtgcgcccgatcggccagccgaacaccgagacgcggctccactttccgttcaacctgcgcgtgctgctcgcgggatggaatcttctgttccggcccagtggcacgtatcgcgaggacctgacgcaaagcgcgacgtggaatcgtggtgcctatctcgtgcaggggctcgcgcactgcggcgcatgtcatacgcctcacggtccgatgggccaggagaaggcgctggacgcacgcgggacggacctgtacctgagcggctacacgctcgcgggctggcatgcgcccgatctgcgccccggcgacggaaacggcgcgggcgagcgcacacgggacagcatcgttcagcttctgcgcaccggacgatcgcacggcagcgccgcgttcggcgggatgtccgaagtggtggagaacagcacgcagtatttcagcgacgccgacctggccgcggtggccgattacctcgtcagcctgggccccggtcgcgcaacgcggacgtcggcggcacctcccgtcaagtccgatacgactgcggcgttgcgctcgggcgtcacgccgacgggcggcgcgttgctgtacctcgacaactgcaacgcgtgccatcgctcggacggcagcggcgcgatgaaggcgtttcccgcgctggcgggcaacgcggtggtcacatccgacgatccgtcgtcggtcattcacgtgattctgaccggctcgcggatgccgtcgacccgatccgatccggcgccgctggccatgcccgcattcggctggcggctgtcggacatgcaagtcgccgagctcgcgacgttcgtccgcggcagctggggcaatcgtgccggcaaggtgagcgcctccgacgtcgcgaacgtccggcggcaggtcgatccggcgcaactgaagcggattcgggccgccgtcacgaacgaagtaaccgacgacggcgcgcccggttcgaccggcaaatgacctcgggcggcccgtatcacgcggaacccatcgcccgcacgcgatcgaagaactgcgcggcacgggccttccaccttgtttgactcgattatcggaaaaccatcatgcgattcatcagctttgtccgcgacggcgccaccggcgtcgccatccggtccggcgacggccgttatctcggactgacgcgtagcgacccggactttcccggcgatctcgacaccctcgtttccggcggtcctgccgcgctggcgcaggccagcgaacgcctccagctggccggccggccgctggacgtggccgattgcaccctgctcccgcccgtgacgcggccggcgaagatcatctgcgtcgggctcaactatgtcgagcactcgcacgaggcgggctacgaggttccgtcgtatccgacactcttcgcacgctttcgcagcagcctgaccgcgcacggcgccgcgatacgcatgccgacggaatcggatcagctcgattacgaaggcgagctggcggtcgtcatcgggcgcggcggccggcgcatcgcgcgaagcgatgcgttgaaccatgtggccggttatacggctttcaacgacgcgaccttgcgggactatcagttcaagacgccgcaatggacggtcggaaagaatttcgacgaaacgggcgcactcggccccgagctggtgaccgtcgacgaattgccggcgggcgcggccggtctcaggcttcagacccggctcaacggtgtcgtcatgcaggacgccaatacgaacgacatgatcttcgacatcgctacgctgatcgccaccatcagcgaagtcatgacgctcgagcccggcgacgtcatcgcgaccggcacgccgtcgggcatcggcatggcgcacaatccgccgcgctggatgcgcgccggcgacgtgtgcgaggtcgagatcgagggatcggcgtactcaggaataccgtcgtgcaatcgtgatccggtcgggccggcgcagcgcgcgccggcacgcgttcagccaggctgcatgatcagcgcatcgttcgcgaggatcatcgcgccggcgttggtgggcctcggccgctccgccggacgaaacaccgcgtcgcctgggaagatcggcaagtgcgtcagcacgcagatgccgcggcgcgacgcgacgacacgccgccagcgctgctcgccgaagtgccggacgccgggttcgacccaacgaaccaccagcacgcttccgtcgcattccagcaccgtcacccgggcacccgcgaactcgcgggcggaacccacgcgcggcccgtcgtccagtcgtgaaatcgcatcaggcatgtcccgctcgcaagccggtgcggtcgagccgtgggcccggtcgaccgcgcgtattcaatcggtcacgtgatcctgaccagcatcttgccggtgttggtcccgttcatcagcccgataaaggcctccggcgcgcacgcgataccgtcgacgatcgtttcgtcatgcacgatctgcccggccctcaaccacaccgccatttcgtcgacgaacgcgtcgcggtgctgccgatagtcgtgcagcaggaagcccgtcagcgtcaggctccggtagacgacgtttgccatgaaccgcggcccgggcgacacgccgacgcggtcgtactgcgaaatggcgccgcagatcgccgcccgcccgccgtaattgaaggccgacaaggccgcctcgagatgatcgccgccgacgttgtcgaaatagacgtcgatacctgccggtgccgcggccgccagctgctcgagcaccgacgcgcgccggtagttgaacgccgcatcgtatccgtagcgttcgcgcatcacggcaactttctcgtcgctccctgccgagccgatcacgtgcgcggcgcctttcagccgcgcgatctgccccgcgagcgagccgaccgcgcccgccgcggccgacacgaatacgacttcatcctcgcgcatgcgtgccaccacgagcagcccgacataagccgtcatgcccgttgcgcccatgacgccgaggtgaacgctgctcgacaggtcgggcaagtccgcgacgcgggtgaattcgaccgcggcgccctgcgcgatgtcgcgccagccgtagcgatgcagcacgagatcgccgggtgcgaacgtgctcgacgcgctgtcggtcacacgtccgaccgcggcgcccgtcatcgtttcatgcagcgtgaacggttcgacatacgacggccggtcgtccatccggccgcgcatgtacggatcgaccgaaacgtattcgttgcgtacgcgaacctcgccgtccgccaacgccggaagcggcacctcgaccgtcaggaaatcgtccgggaccggctgaccgttcggccgtctcgccagttgaatctgcgtgctgatcgtggagaacctcaccgcccctctctccttgcaagaacccagggtgccggtggtgccggccgggcacgccgcacggatgcggcggcgtaccgcgcctcatgcaccggcgattcggacttcgctcacgtgctcgaccgacggcgggcccacgaagaaggggccggccagttcgcgccaacgctgaaaatcggctgtctggcgaaaggcgtcgtgcagcgcgacgctttcccattgcaccatcaggcggtagcgcgacggttgctcgataccgcgatacaggcgcaagccatggcaaccaggggcgcgttcgatgagcggcttcgcctcggcgaccgcgcgctcgaattcctgctctccgttttcctggatctcgatctgggcaatttcaaaaatcatggcgggtttctccgcgcaacgcgaaccgtcgcgcagtgcaattgacacgatgccggcatcgatcccgggccggacattccgggtgggcggcgcgtgcatgtgcgctgccctgctgccggctcgcgtggacaggcgaacgcgccccaatcgtcgacgggttcatgcgcggttctgcacgacgtcctggcagtttttcagccgcggtcggatcggcagatgaggtcggtgcggaacgatcgagtcgtttcatgctgcgcagtctcgctccggaatcgaacgacgtcaccgcacccgctagatacgaaccggcctgcatcgtttcggcccgtcgcgacgatgagccaacgatagcgttgtcctgccgaccgctctacccccagtacgggggtgaaaaacctcaggaagcaccggcacccgaggctgacggcaacccgcagccacgcatgccgaactcgccgaccgaccggcgttcgttcgagccggtcactgtttgccgccgacgacccgctgccatgcggcggcctgttcgtcgcgcacgagctgctcggcggagtcgggcctgaccgtgcgatacggcggcgcctccgcctcgatcaccgtgacgatggcgtcgatcatttccgcgggatcgtgttgccgattcagttcgcgcgtcggccaatgggcgacgacgcgctcgccttgatcccaccactgatccatgctttccatgccggtatcgttgaagccggtgcgataggcacctggattgatcgtgacgacttcgacgccgtaaggctgcagttcttccgccatcgcggagcagatgccttcgacggcatgcttcgacgcggcgtaagcgccgtcgaacggcaccttgatcaatcccgcgaccgacgacatccagacgatccggccatgcccgcgcgcgaccatcctgcgcgcgaatccctgcgcgacctccagtgccgcaaagacattcgtttcgaagaccgaacgaaacacggagatcgggatctccacgagcgggccggactccatgatggccgcgttgttcagcaggacatcgacctcgtgcgtcaatgcgtgcgcacgatcgatttcgttcgtcacatcgaacttgatgacctgcatgtccacgccgcgcgccttggcctcctgacgcagtgcccagacctgcggccagatctggccgcacgcgatgacgcgatgcccccgctccgccagtgcgaacgcgacccctcgcccgaatccggaccccgcaccggttatcaacaccgttctggtcatgcatcctcccgctcggttcacgatgattgcgcgcccgtccggacggcgatcttgccgactacgttacggcgtttcccgcagccaacggcccccgaatggggaggcggtccgcatcgacgacacgggtcggaagcggccgcatgccgtcagtcgcagcaacgcccgattccggcgagcgccttatgacacggcccttgcggggaacggataccccgttcgccgtggccatgcgcgccgcgtcaaccgcaaacgggaccgatcggaaagcgtgaaatcgcgccccaccctcactagacgactggtctactcagccgtatgatccgcgtcacggttcgaccgccatgtcggccctcgcattcatgcgatgcatggcgcaacccggcgcaccccgcaggtcatgccctgtgacgttgcccgcaagcgtccacgctatagacgactggtctactttgttcgtgcgtcgtgccgtcgcggcacgtcgtcccgcgcatctcgaccgtcacgcgaacaacccgccgccgccgacacgatcccggcggcgaaaccgttacacagaggtcacccatgccgcattccccatccgtcaatcgccgggtcgtcctggccagccgccccgtcggtgcgccggcagcgcacgacttccggctcgaaaccacggcggtgccgacgcccgccgacggcgaagtcctcctgcagacgctttacctgtcgctcgatccctacatgcggtggcgcatgagcgacgcgccgtcctacgcgccgccggttgcgctcggcgacacgatggtgggcggcaccgtcagccgcgtcgtcgcgtcgaagcatcccgcattcgcggtgggcgagctggtgctgggcgacagcggctggcaggactacgcgctctccgacggcgccgacctcatgccgctcggcacggatctcgagcgcccgtcccatgcgctaggcgtgcttggcatgccgggcttcaccgcctatacgggcctgctgaagatcgggcaaccgaagccgggcgaaacggtcgtggtcgcggcggcgagcggcgcggtgggcgccgtcgtcggccagatcgcgaagctcaagggctgccgcgtcgtcggcattgcgggagacgcggagaaatgccggtacgtcaccgagacgctcggcttcgacgtgtgcatcgaccggcgggcccccgatcttgcacggcagctcgcgcaagcctgccccgacggcatcgacatctacttcgagaacgtcggcggcgcgattttcgacgccgtgctgccgctcctcaacgtcggcgcacgcgtgccgctctgcggcctgatctcgcaatacaacgacagcgaaccggcgcccggtcccgaccggctgccgcgcctgaccgacacgctcctgaagaaacggatccgcatggagggcttcatcatcctcgaccactatgcgaccggctatcaggcgttcctggccgaaatgggccgttgggtcgaggccggcgagatcacgccgcgcgaagacatcaccgacggcctggaacgtgcgccggaagcgctcatcggcctgctggcaggaaagaacttcggcaaggtggtcgtgcgcgtcgccgaagtcgctgcatgaagcgaattcgcgcatccctcattcatctccatccccagacatcatgaaacttctgttcgtcctgacttcccacgacaccctcggttcaaccggcgagaaaaccggcttctggctcgaggaattcgcggctccctactacacgctgaaagacgcgggtgccgacatcacgctggcgtcgccggccggcggccagccgccgctcgatccgaaaagcgcggaccccgcgttccagaccgacgccacgcgccgcttcgaagccgatcggacgcgcgcgccgcgctcgcggccacgcaaaaactgtcggaggtcgcggtcgacgcgttcgacgcggtgttctatccgggcggccacggcccctctgggatctcgccgaagacgcacggtcggtctcgctgatcgagcaggccatcgccctgggcaagccggtcgcagccgtctgccacgcaccgggtgtgctgcgccatgcgaaggggccggacggcaagccgctcgtcgccggcaggaacgtcaccggcttctcgaattcggaagaggatgccgtcgggttgacgaacgtcgtgccgtttctcgtcgaggacgaactcaagtcgaagggtggccgttattcgaagaccgatgactggcaaccgtacgtggtcgtcgacggcctgttgatcaccggccagaatccggcgtcgtccgaaccggccgcccacgcgctgttgaaactgctgacgcgcgcctgacccgcggagcgcccgcgccggcggcgaacatccggttcgccgccggctcgcacacgaacgacacgcgcgggaacacggccgtcgcgcgatcacatcgatcctgatcccgaaaaagcgtttaacaccacgcgcaatactcgaacgcacctccggaaaatacaatcacggtcgtcctgtcgtcgcacgcctgcatcgcgcaccacatccatcatgtcttcgccgccctccagattcacgtcatctatttcggatacccaaacaggcatcgccgatgcggcccgtcattgggccggcacgagcggcgtcacctggctgtacatcttcaagaccctgctcgccgcgctgctggcgctcggcgtggcgatgaagctcgaactcccgatgccgcgcacggcgatgacgacggtcttcgtgctgatgcagccgcaaagcggcatggtgctcgccaaaagcctgtaccggatctgcggcacgatcgtgggcctgctggccatgctggtgctgatcggcctgttcggtcaggtacccgaactcttcctcggcgccaccgcgctctggatcggcatgtgcaccgcaggtgccgcgcggaaccgcaacttccggacctatggattcgtgctcgccggctacacggccgcgctcatcggcatcccgtcatggcagcatccggacgcggcctttctttctgcgatgacgcgtgtgacggaggtgacgatcggcatcctgagttcgggtgcagtcagcgcgctcgtctttccgcagcatgtcagcgaacagatcagccgcgtgaaccgcacgcggttcaccgcattcgcggacgacgtgctgtcgattctgtccggccggatcgaccggtcgtttctcgaggcgctgagcgtgcgcatcgtcgacgagaccgtgagcgcggaagccgcgcgcagcgcagcggtgttcgaaggccccgacacgcgcctgcgaaacggccgcctgacgcggctcaatgcggagcgcatggcggcgtcgacgcggttgcacgcattgagtcagctgatcgcccggctgcgtgtcgcgcgagccgatgaggtgctgacggagatcgacgcactgatggccggtatcgcagagccgctccgactcgaacggcaggacgcgacgcacgccgacgatatcgacgcattcgccgcgtcgctggccgccacgctcgagcactgccgcacggcgctgcccggccgcgcgcagtcggcgcgaaaccggctcggcagcggcgcggccgcgctcgatttcgacacggcggtcgacctgctcgaccggttcctgggcagctatatcgcctatgcgagcacctatctgtcgctgaacgccaccgcgcacgagcgcgaacagtgggtgacgccctacgaaccgcgcaccaatccgctcatcgcggcagtcgccggcgtccgcgcgatgctgctgacgctcgtgctcagcgcgttctggatcgcgaccgcgtggccgtcgggcgccctgctcgtgctgaacggcggtgccatctgcgcgctggtcgcgtcctccgcgcacccgtctcgcacggcgttccagatggcgatcggcaccgcgttcgcgtccgtcgtcgggctgatcgtcatgttcgtcgtctatccggtcatcgacggcttcccgctgctctgcgtggtactcgccgcgccgctcgcattgggatgctggatgacgacgcgcgcgtcgctggccgggtacggcatcggctactgcatctatttctgctttctgaccggccccgacaatgtcgtcgcctacgatccgacgtccttcatgaacgacgcgatcgcgctggtcctgtccatgctgatggcgtccgtcgcgttcgagctgttcctgccgccgacgatgcgcgggttgcgccggcatttgctggccgacctgcgcaggcaggtcgtgttcgcatgcaccgattcggtcgcaacgctgcgcacgcgcttcgaaagccgcacgcgcgacctcatgtatcaggtccggtcgatatcgcgtgacgacccggtggcaaacggcgagtccgtcgaatggtttctgtccgtcctcgagatcggctcggccgtcgcggacctgcgcgacgcaacggccatcgaggcggcacgaaccgcgccggacgccgcaccggcctggctcgacgattgcgcatccgcgtgccgcgcgatccggctgctgttcgaggcgccgacaccgaaggccagcgctgctgccacgcacgcggtacagattgcaatcgccacgctgcaacggacgatgcagaccaccgatgcggcaagcccgtccgcgccccgccttcagacggtgctcggcagtctgcatttcattcacagcgcactcgcggcacccgactcgccgctctccgctttccgcatccactgaccacgcgtcggcacccggccgcgcacaccggctcgttcaccggcgcgcggcgggtgacacggttcgttccgcgtcaatgctcgacggcccgttccgcaccgagcccggtctgcgcgcgcacgaactgggcgtcgaacgcatgccgctccgcgtcggccttcgaactgcgatcgagtgtcgacatcacgtaactcgccaggaacgccagcggcatcgtaaacagcgccggatgatcgtacgggaacacggcagccggatgcccgagcaccgacttccacaccgccggcgacagaatgaccagcgagaccgacgatacgagcccgacgacgccgccgcagacggccccgcggctcgtcagccccttccagtacatcgaaagcacgagcggcggaaaattcgccgaagcggcaacgttgaacgccagtgccacgagaaaggcgaggttctgccctttgaacaggaggccgagcacgacggccacggcgccgatcgccagcgtcgtccaccgcgtgacgcggatttcatcggctccgctcgcccggcccttgcgcaacacgcccgcatagaggtcgtgcgatacggccgacgcacccgccagcaccaggcccgacaccacggccaggatggtggcgaacgtcaccgccgcgaggaaaccgaggaacaggctgccgcccgtcgcgtcggcgagatgcatcgccaccatgttgctcccgccgcgcagcacgccgcccacgcgtccgccctcgaagaactgcggatcggtgccgacgatcacgacgctcgcgagaccgatgacgaacatcgcaatgaacatgaagccgatgcacgtgctcgccacgaatacgctcttcctggcttcccgtgcattcggaacggtaaagaagcgcatcagcacgtgcggcagtccggagagcccgaacaccgttgcgagcgacatcgagacggccgagacggggtccgagaacaggcggcccggctccatcagcgcgttccccgcgtggtgtaccgagatcgccgaccgcgcgagccgttcgaagctgaaaccgaagtgaccgagcgccaacagcgtcagcaacgtgccgccgaacatcagcaggacggccttgatgatctgaacccacgtcgtcgcgatcatcccgccgaacgtcacgtagacgatcatgagacacccgacgccgatgaccgcatagttgtagtcgatgccgaacagcagctgaacgagttccccgcgccgaccatctggacgatgagatagaagaacacgaccgtcaacgaactgaccacgcccatccagcgcgtgctgaccggatcgagccggtaggcgatgatgtcgacgaacgtgaaccggccgagattgcgcagccgttcggccatgaggaacagcatcaccggccatccgacgaagaagccgacgacataaagcaggccatcgtagcccttcgcgtagacgagactcacgacgccgagcaatgtcgcggcggacatgtaatcaccggcgaccgcaaggccgttctgaagcccgctgattccgccgccggcggtgaggaagtcgttgaccgtcctggtacggcgcgccgcccagtacgtgatgcccagcgtcatgcagacgaacaccatgaacatcgcgatggcggccggattgagcggctgacgctgccccgcctccacggcggggccggcccacaaggccgcccggcgcggcggcaagcgcgcatgccgcggtcgaaacgagtgcgatcggtttcattgccccacctcgcccagcaattcgccggtcagacgttcgaaccggtcattcgcgacgcggacatacagccacgtcagcccccatcccgcaacgatcacggcgatcgcgaagatcacgccgacggtcgtgacgctgccagcccacgcggcgctgcgcaacaggtcgggccgcaacgcgaccagcgcaatcaagccgaaatacgcgcccagcacgacgaccatcgacacccggcccaggcgtgcgcgttcgtcgaccagctctcgaaacttcgcgtgctcccggatacgtgaaactgcgcttgcattcaacgtcatttgtctcctccatcgccagttttgagaatcgggatcgcttgtgtatccgtcatcccgtcaatcgattcgtcgtccgtaagatagggttcgcttccttgcccggtcgacctttgctgcgcgatcgccaggacgaccgagcttatttccgcgatcggcgaatagcagcccccacaggtgggggcatcggcgcgctcacgtgtccccgggaaacaccgactgttcccgtcgacgaccgtcactcggggctcgcgcacgcacggaatcccggggcgagcgacgcgaggcgaaccgcccccgtccggggtggaaaaacgtgtcttcgcacggtatttctcacgaatcgccgctgctgccgcgccctcctttcattcgcgacgtcatgaaccttttccgtaccgacctgaacctgctggtggtactcgaacgcatctacgcccagcagagcatcacgcgcgcggcgcagcagctcagcctcagtcggtcggcggtcagtcatgcgctgaaccggctgcgcgagttgctcggcgacccgctgttcgagcgccacggcaatgccatgatgcccaccccgttcacgagagcgatcattgcgcgcgtgcgcaacggcctgcatacgctcgaatgcacgctgcatgaagccagccggttcgatgtcgcgacgacgatcaggcgtttcacgatcggcatcctcaatgcgcaggaaccggtggtattgccggtcatcgcgcaatacgtcgcacagcacgcaccgtcgatcgatatcaccgcggtgcaacacgaccggcgcgcgatagaggccgacccgctcaccggctcgctcgacgccgtgatcgacgtgctgctgccgcacccgcaatccgtccgcagtacccggctgtcgaccgaccggtacgtcgtgctgtgccggcgcgatcacccgcgcgtcggacagtgcctcgacctcgacgcctatctcgccgaagagcacgtgctcgtgacgagccggcagcgcggcggcggcgtcgaggatgccgcgctcgtcaggctcggcgccgaacgccgcgtgccgcgtcgtcaaccagaccggcctgctgctgaccacgccggagcggtacgcgcggctgctcaacgagatgtgcggcagccggatgctcgaatgcccgttcgacgcgtcgatcgatacctatctctactggcacgcgaatgccgatgccgatcccgcgaatggctggctgcgtcggcaaccgggcgacgtattcgatcccgttcgcgcggacacggcgagccgcccgtgatgcggtgcctcgtcggccgctcgctcacccgcgcatctcgcgccgcaggatcttcctcgtcatggtcttcggcagttcgtcgatgatctcgacgacgcgcggatacttgtatgccgccatccgctccttgcagtaggcgaccggctcgtcgggcgaaacttcggcatgcacgcggcgggtcgaatgcagcgccctgaattgcgaagatccttcgaatgcgaacattcggaggatccggtatcgctcagcaatgcgacatacggcgcatcactgcccgccttccatgcgcaactgaagcttgctggtcaccgacgtgacgcccggcacctggcgagccgcttccaccgcggccttgtcctgcgactcgtcggtaatcaatcccgccagcgtcacttcacccgtctttgccttggcaaagacggtgacctgtgcattgccgatcccgtgcgctttcacgatcgcctgacggaccttcttcgcaaatgcacggttttccaggcgctcggccttcttggccgagcgcgacggggcagccgtctgcgtggccgtttgcgtgtcggggctggcggattgcgcgtaggacgtgacggacgtcaatgcgacaaagccggcgacaacgatcataaggcgtgacttcatcatgctctcctcaatttgaacgaacgggaaactacgggtgggtgggtactcgaatcggcccggtattgcacctgcgtcgcgccggccactgccggttgcagtgcgcaggccttatgcggcaatcgcattcaacgcaccttcgtcggcttccagcgccggcgaaagcgtcatgcgcagatgctcgagaaatgtccgtatcttcgcgtccatgaactgccgggatacgtacatcgcgtaaacgtcgagcatcgtcaggcggtaacccggcaacaccctgacgagtttcccgctccgcagatcgtcaatgacggaatagatcgccaacgacccgatacccatgccggcacgcaacgcgatcgccagcgcttccggtgcattcgcctggaacggggccgagagaacggagtgtgattccacctcgccgcgcgtgccatgaagcaaccattcatcgttcgagtcggccggcgtgtcgaggcgcaagcacgtatggtcggcgagatccgccggcttcgacggggtgccatgccggtcgagatagtcctgcgacgcgaccagcacgctgtagcaccttccgtaggtatgcgcgatgtatcccgaatcgggaagactcgacgccgcgaccaccgaaatgtcgtagccgtcttccaccaggttcggcatcctctgcgaataggtgatgtcgacggccacctcgggaaaagccgcctgataggtgacgacggcctcggtgacatggctttgccccaggcccggcatcgtgtgcacgcgcaaccgcccgtatggccggacgagtgcgtttctcgcctcggcattcgcctggtcgacatcgccgaggatggccagcaggcgctcgaaataacgccgtccgctgtcggtcagcgaaatcctccgggtcgttcgattcaacaagcgggtctgtgcatattcctcgaggccggataccgcccgcgatacctgtgcaatcgccacatcggtctgtttcgccactgccgtaaagctgccggcctgcacgacgcgcacaaacgtccgcatgttctcaaggatgtccatttcgacccatcatccagtgctgcatccacgcgacacgccagcgaggtgcggcgacgcgttcggtgccaccgattgtccggcattccgcgccgacacttcagcccccggtcgggggctgaagtgtcggtcgatcatgtggaatgcttggcgtttgcgtcaacgcgctgatcgcgcagacgcaccggtcgcgagccgatatgacgacggaacctcatccgctcgagcgtggcgcgctcttcgtgacgaacgaacagtccgtacacctatgggtcgacggtcgatgtccggatcagaggctgtatcgcctgccccggccaatcgcctgcgggcgcaagccgttcattcgccgcctgggcgcgtgcgggacgcttcgagcgccaacccgctgcgcacggcctggatgcgcgacgtgacgttgagtttttcgaagatgttcttcagatgccacttgatcgtctccggcgcgacgcgcagcgcacgggcgatttccttgttcgagagcccgcgcgcgacgtagtcgaggatctcgacttcccgtgcgctcaggttgccggccacgccgggccgcccggccggcgtcgcgcccgcggcgcgctgcgcgtcgaacgcgcgcgtcagttcgcgcggataccacgccccgagcgccggaaaccgctcgagccggttctgcacgcgcgccaacatgcgctcgaccggcggaccttcgtcgacgaaggtccgcacgagcccgttgccctgaccgtattcgagcgcgcgggcgagcatcgcgagcgccgtctcttcgtcgcccgcctgttcgcacgcgagcgcgcgcaacacggccgcctgcgccgccagccagtcgaacccgcgggcagcaagcaactcgtgcacggtcgccatgacttgcgcggcctcgtccgcgcgcgcatcggcaagcagcaggcgcgcacgtgcggattgcgccatctgccatgtctcgacctggctcgacgtttcttccggcggcgcctccgacaccagcgacgcgagcgcccgccccacgcgatgcgcctgcgtcggcttcccggcgtcgaggtgaagccggatgccggtcgccatgcatgcaacgcgcagccgcagccattgccggctgcatgcgatgtgatcggcctcgtcgagcagttcgtgcgcgcgcgcttcgtgcccggcctggaactgaagcaatgcggcggtctgcacgaacctgagcagcggccccagcgaacacgcctgcatcgcgatgtcgaagcggtcggcctgcgcgtcgcgcacctttgccagtcgttccattcgtagtaaatggccgacaggtaaccggacgacagcgccgtcgccgccgacaggcgcccgccgcccgctccgcggcacgcaacgccgtttcgaacgtcttcgacgcgtcgtgcaagcggccggcgacgaactccgcgaggccggacatgttctggcgatacacgttcgcaaacagcggttcgtggccggacgccgcgcgctcggcccgcgcccggaggtccagcgcgtcgtcgaggcggcccgcgtacccgagcccgaaactcagcgcggtctgcccgatctgctcgacccacgaaccggacggcgggccggccgcgagtacacgctcgcccaggtgcagcgcctcgatgctgcgatccgacagcgcgacgatcagcgagcggacggccagcaactcggtcgccgtgacggcatcggtgtcgagccgccccgcgtcgatgtcggcttcgagcgcatcgagtgcgtgccgcgcgtcgatgatctgcatcgccagtgccagcgcccatgcatgcgcgatccgcagccgcagccggcctgccagcgcctgcccgggcaggcgcgacacccagtcgagcacggtgcgcacgtcgctcgacgcgatcagcttcatcgcgcatgcctcgacccaggcggcggccgcgtcgaaatcgcccgctgccagcgcgtgccggaccgcgtccggccactgccctccgccgcataccactcgctcgcacggcgattgagcgtcgccaccgcatcgggctcgcgcagcgccagttcctcgcgcaggtactgcagaaacaacgcgtgatagcgataacgctggcggtcgccgtcgatcgaccggatgaagaggttatgcccgaccagccattcgaggcagccgagcgcatcgtcccggccggtcagcgcatcgcacagcgccggcgtcatccggtccagcacggccgtgtgcagcaggaagcgccggatcgtgtccggcacctgcgtcatcacgttctcgttcaggtacgcggcgatgccggcccgggcatggctgacctgttcggccacgcgcgccgcatcgttgtcgtcgttcaatgcaagcgccgcgagttgcaggcccgacacccagccctcggtggccgcgcgcaggcgctccacgtttgccgcgttgagcggcttgccggcgatcagctcgaagaacgagcgcgtttcggcatcgtcgaaacgcaagtcgttctcgtcgattctcacgagctggtcgcgcgaatcgaagtagctgagcggcagcgccggtgccgaacggcacgacagcacgacgtgaaggttcgacggcgcgtagcgcagcagaccgaacatcgcgtcgtggatgaccggcgacacgaggcgatcgaagtcgtcgagcatcaggaacagttcaacacccgaactttccagctcgttgagcagttcgtcgaacacgaccttcagcggaatcagtgcgcggtcgcgcagcatctgccgggcatgcgcgccgaccccgcccgtcgcgtcgacgattgccgcgacgacgtaggacgaaaagatcgacgcgttgtcgtcgtcctggtcgaggctcacccacgcgaccttcctgcccgattcgaccagcgtgttgcgccattccgccagcagcgtcgtcttgccgtacccggcaggtgcgcagacgagcgtcaaacggcgatcgaggccgcggcgcagccgccgagccgcgtgatgcgcgacacgatcccgctggccgacggcggcgcgagcttggtgcgcacgagcacttcgatcgtgtcggcgtccgccgggctggttgatcgtctgttgtccctcggcgtcatgctgttcacgttctcctcgcgcactgcgcgtatccgcccggcaggaaaaagcaccgccggccgcccggccggatgcccggccacggcccgcggcgctccgcaacagcatagcgagtcggcgccggccgtcaaaagtaggtgatgtccgtaccgctccgcccgctcgcggcgccgcgtcgcggtcggctccaaaggacccgcattgttcttgaacgggcgcacgatgttcagcccccattcggggtacctcgcacgacaatgtcgtttcattctggcaactcggcatcgcgggcgacccgcgccgccaccgacgctgcgctttccccaggagccgccatgaacagtcgcgacgccgtcgccgcgtttttgatcggtatcgccggcatgacatcgaagggatgctcacgctgttcgcgccggatgccaccctcgactacgtgccgatcggcgtgaccggccgggcggacgtacagggcaaggccatctgggcggcgctgctggacgcatttccggacctgcacaacgaggtcgacgccattcatgcggacgacgccggccgtcacgccaccgccgaagtcacgatcggcggcacgcaggtacgcgaattcgccggcatccagaaccgcggacgcacgttctcccttcggcatgcgttcgtgttcgagttcgataccgacggccggatcgaacggctcgccgcctactgggacaacgtccggctcttcgaggatctcggcaagacgaccctcgggtgacgtcctccggacgattccgtcgtgccgacccggcgccgcaccgcaagtgcgagcggcgcccggcggccacgccgcactcagtcgggctcgtagcgctcgcgcagcgcgcgcttgttgatcttcccgacgctcgtcttctcgatcgcgtcgacgatcagcaggcgctccggcaccgcatagcgcgagatcagcccgcggtcggccacctgcttcacatgcgcctgcaactccgccggcccgacgcggcccacatgctcgtcagccagcacgacgagcgcgagcggccgctcgccccaccgcgcgtccttcacgccgatcacggccgattcccggacggccggatggcgcgacaggatgtcctcgagctcaagcgacgacacccattcgccgcccgtcttgatcacatccttgatccggtccgtgatctgcagccgaccgtccttgtcgatcacgccgatgtcgttcgtatgaagatatccgccggcccacagcgcggccgatgccgccccgtcgccgagataaccctgcgtcgcccacggcatccgcacgacgatttcgcccgccgagcggccgtcgtgcggcacgtcgcggaattgggcgtcgacaatgcgcaggtcgacgagcggcagcggcaagcctgccttcgtccggcgcgcgatatcgtcgtcgtccgtcgtgcagccggacccgagcggcggatcgacctgcgcgatcgtcatcagcgggcaggtttcggacatgccgtaacccgtgtacacctcgatgccgcgcgcgagtgccgcccgcgccagcccctcgggcagcggcgagccgcccacgatcaccttccacgacgacaggtcgatcccggccagcgccgggctgtcgaggatcatcgcaagcagtgtcggcacgcagtgcgagaacgtcaccgattcgcgcgcgatcaatgcgagcaatccgtccggcgaatagcgccccggataaacctgcttgaggccgagcgcggtcgcgatatacggaatgccccacgcgtgcacgtggaacatcggcgtgatcggcatgtagacgtcgtcacgatggattcggccgcgatcgcgcgcgctcgacaacgccgccatgccggccaacgtgtgcagcacgagctggcgatgggtgaacgccacggccttcggcagccccgtggtaccggtcgtgtagaacgtcgtcgcgcgggtctgttcgtcgaaatcggggaacacgaaatcaggcgggctggcgccgacccaatgctcgtactcgtcgacgaacccgtcgggaaggtcgatctcggctccgtcgccgatcagcacgaaccgtctcaccgtttcgagccggtcgcgaatgccggcgagcatcggcagaaagtcgcgatgcaccagtgcaacctgcgcccccgaatgattgaggctgtacaggagctgatcgggagacagccgaacgttggcggtcatcagcaccgcccccatcatcggaatcgcgaaatagcactcgagataacgatggctgtcccagtccatcaccgcgaccgtatctccggccccgacgccgatcgacgacaacccgctggcgagttgacccagacgatgacggaaggtccagtagtcgtggcgcacctggtcgccgtaaacgatttcctgttccggccgcgtcgccagcggggtgtgaagcaattgcttgaccagcagcggatacgtggacgcggacggcaatggctcatccgggagccggaatgcgaagggttcatgagagtctccgtgagcggcgacgtggcccgattcaaggtttctggcggccatgcaggccgtcgccaacgccggtttgcgtcggccagggtgacagtcaagataccgtaccggcatacgccggacaccccacgttttgggggacaagccgtcctggcggatcggccatgccgcgatcgatcgcgcgggcggcaacccacctgatcgggggcaattaatcccggccgcgttgtaagatttccgggcatgctcgcgcggcctggcgaaatcgccgtcttcgcctcgaagtgcaaaggagacctaccgagcagactcgaaggcctccgtcggctgagcacggccaatcgtcgacgccagaccgattcctgaacccagtccagtgaaaggagcagttatgaccaccgagccgcagcaaacggacaagatcccctcgcccgatccggccgagaacaatgcgtactttccgtctccgtattcgttgtcgcagtacacgtcttcaaagaccgacttcgacggcgcgcattacccgaacccgtacaagggcggcaagtggaaggtcctgatgatcgccacggacgaacgctacgtcctgatgacgaacggcaagatgttctcgaccggcaatcatccggtcgagatgctgctgccgatgcatcacatggatcaggccggctttgaaatcgatgtcgcgacgctttcgggcaatcccgccaagctggagctgtgggccatgcccggcgacgacgaggccgtgcagtccacgtaccggaaatacctgccgaaactcaagacgccgctcaaattgtccgacgtgctcgaaaaggacctcggcgccgattcgccgtacatcgcggtgttcattcccggcggccacggcgtgctcgccgggattccgcacagcaaggaagtgaagcgaaccctcaagtgggcgctcgacaacgaccggcacatcatcacgctgtgtcacggcccggcgtgcctgctgtcggcggccgtcgacgaggatccgcaaaactatccgttcaaggactacgaggtttgcgtgttcccggatgccctcgacaaggggccgaatctcgatatcgggtacatgccgggcccgcttccgtggctcgtcgccgaaagcctcgaaaaactgggcgccaaggtgttgaacaaggacatgacgggccggtgccatcaggaccggaaactgatcacgggcgatagcccgcttgcgtccaacaacatcggcaaactggccgccgcggcactgctgaaggaagtcgggaactgacgaccggcgtgcatcgcgcaattgcactggtgttacgcatcaccggtgcaattgccgtcgtcatcggcgccggcaacaggcaactgtttccccgggacgggtgcgctacgcgttcgatccgttggcaaagccttcgtcgagcatgggtgcgcttcaatgtcgactaaaccgcaatccccgatttgattggcttcgtttgctgcgtgtgctcacgcagcatcaggttcattcaaaaataccgaggatgccaaatcatcgaggaaagccattcccgcgttatctgcacagcgcatcccgagcagcctgaagtatttcttccgacagcgcctcgttatcgaccacgcgcgacatcatcagcgcaccgatcatggctgacgcggccgccagcgacttgccacgcttgcttgcttccgtgccgcccaactgtgcctcgatgagacctgcgagacggagaaacccgtccgtcgcgacttgccgcgtgcgcgaatcggctctcgccatatctccacccagcgccgcaaacgggcagcctatcgacatattgtcgcgatgcgcgaccgacaggtaacgctccgcaatctcccggcgcgcctcacgaggcggtttccctgcacgaacgactcgagcgttccgtacagcgtcgcgctggcgacatcgcatgcttccgccacgagatggtccttcgactcgaagtgccgatagaacccgcctggggtcaagccggcagccgacatgatgtcggcaatccccgcaccaaccacacccttctcgcgaaactcccttgcggcggtttccacgatccgcttgcgggtctcgcttgcctcttccctcgactttctcatatcgatcctgcgcctgagcgctccgtgtaaaacttcccgttgacacttagagtgtattcatactctaattggatgtcgaccatactcttatttacccaagggggcggaagtgggacaggactggaaacatggatacgtccataccaacggcattcgcatgcactatgtggagcagggatccgggccgctgatcctgctctgtcacgggtggcctgaatcgtggttttcgtggcgccatcagatcgcgccattggcgcgggccgggtacagggttgtcgcaatggatcagcgaggctacgccgacaccgatgcaccgcaagcaatcgacgcatacaacgtcctgaatctcgttgcggatctggtcggcctggttcatgcgttggggaagaacacgcgattctcgtcgggcccgattggggatccatggtcgcagcgtccgccgcactgcttcgtcccgacatgttccgcaaactggctttgctgagcgtgccgtacctgccgcgccagacactgcggccggccgtccgctttcaattgctcacgcaggagcagcatttctatcaacagtattttcaggaaccggggcggatcgagcgcgagctcgaagccgacgttcgccgcgctttgctgggcattctgtattcggcctcggggcaggctcgctcgagtgaaaaacaccgccattccagcttcgtccgtttcgacaaggccagtcgtcttgtcgacagtctcgtgttccccgacgagcaacccgcgtggctgacgacggaggaactcgactacttcacggctcagttcaaggtgtcgggtttccggggcggcatcaactggtatcggaacttcgatcggaactgggagctgacgccgttcctggacggcgcgcgcatcctccagcccacggtcttcatcgccggtgaactggatggcgtactgaagatggcgaaggatgaatacgagacgctcgaacgtaacgtgcccaacctgaagggaaaacacctgatcgccggaatcggtcactacgcgcagcaagaagcgccggacgcagtcaatcagctgctgctgtcgttcctgtccgaccggggatagggacgaagcatatggatcagacttcaaacaaacccgatgccggcgcgctacgtcgcgcccgcattctgggcggcccctgtttcgaacgctgctgtcgctcggggtgaccaccatggccgtattgatcgcccagacattcgtcggcgtgctggagacgtggtacgtgagttttctcggtaccgattcgttggtcggcgtgtcgcttgtcttcccgatctcgatgttgatgacgatgatgtccaacggcggcattggaggtggcgttgcgtccgccgtggctcgagcaattggcggcggcaaacggcgcgatgccgatgcgctcgtcctgcatgcggttgtcgtggccgtggcactcggctgccttttcacgatattggcgtggtgctacggtcccgagttgtataccgcgctcggcggccggggccgggactcgccgcggcggtgacctattcgaactacgtattcgccggcgccataccggtctggatcgtcaacttgatgtgcgcagccctgcgcggtagcgggaacgtcaagattcccgcgatcacgactttcgccggtgcgctggtgctgattccgctttcgcctttgctgattttcggcataggccctgtacccggcctgggcattgccggtgcgggtatcgccgtctccctctattacagcatcgccgccgtcgcgcttctgatctacatggccaggggcgcgccggattggtcctgacacgcacgccgctgaatctgcgtttcttttcggacattcttcgggttggtgcgctctcgtcgataggcgcactgcaactgaatctgatggtcgtattgctgaccgcggtggtcgggcgttttggccaggctgcgctggccggctacggcatcgcctcacgactcgactacgtcttgataccgctgctgttcggcctaggtaccgccgtgctgaccgtcgtcgggacatgcatgggagcgggcgacatcgcgcgggccagacgagctacatggctcggcattgcgatgggagccggcttcacgcagatcatcgggttggtcgtcgccatccatcccccgtctggctgggcctgttcacgcatgacacggccacgacacacttcggggcctctatttgaggaccatcgcgccactctacggtctggtcggtgtgtctttcatcctctcgtttgcggcccagggtatcggccgtcctttctggacaatcctgggtggaacggctcgcttgctcattgcggccggtggtggatggctggccgtcaatcagctgggggcggcatgggcacgctgtccgccttcgtcgcagcggggacgatcggttcagcgctggtatgcgcggccacgatggtgcccaaacgtatctggactcgggtcgaggtgtgacggatcgcacaacgacccgccgttatcgatcggctatatctggagaatggtgaaatgaatcgtaccgtcatcgctggttatgtgcgcacgcctttcgcatttgcacgcaagggaccctttcatgcaacgcggccggacgatctcgccgccgtcgcacttgccgaactggtccgacgcagcggaatcgatccgcacctgatcgaggatgtactgatggggtgtgcctatcccgagggcgctcagggcgacaacgtcgcacgtatcgcatcgctgctcgcgggactgcccgttcaaatcggtgccgcgacggtcaatcgcttttgcggctcgtcgatgtatgccatccacatggcggccggacagatagccatcggtgccggcgaagcgttcatcgcggccggtgtcgagagcatgacgatggtgccgcaaggcggcttgtcggcgtctccgaatccgcgtttcgcgtcgagagaacatcccgatgcagacgttccgacccaggcgtacacaccaatgggcatcaccgccgaaaacgtggcggcacgctgggctatttcgcgtgagcaacaagacgcgttcgccgtcgagtcacagcgcaaggcttcacgtgcgcaagccgaaggtcgtctggacgacgagctcgtgccggttatcacgcccgacggcaccgtggtcgatcgcgatctttgtctgcgtccgcagacttcgctcgaagggctcgccgcgctgaaacctgcgttcggggaaggcggtaccgtaacggctggtactgcctcgcctttgacggatggcgccgttgccgtactcgtcacgtcggaagcattcgcgcgacagcatgggctcgacatgctcgcccgtgtacggtcgactgcaattgcgggccttgaacccgaaatcatggggatggggccggtacacgcgacccgcaaggcacttgcgcgtgccggcctgcgcatcgaggacatggatgtgatcgagatcaacgaagcctttgcctcgcaagcgatcgcatgcatgcgcgagctcggcatccatcccgatcgaaccaatatcgacggcggagcaatcgcgcttggccatccgctcggcgcaacaggcgcacggatcacggccaaggcggcgacgctactgcgccgtgtgaatggtcgttacgcgcttgccacgcagtgtatcggtggcggacaagggatcgcgactgttctcgaagcgttgtagtcacccgttcgatactcgccctgcaggctgcgctccgcgcgcagccttgaacgtggcgcgaagcggccgccacggacatccatgtcgctgccggcaaccagcatccgcactgcgtgttcatctcctcgccgtgcaagggcgcatcgggcagacgtgtgaagcacggaaggacgacccggtggaactcatcgtgttcgagaacgtgccacggctcgcgacgcgggcgccacctgctcgaccagaatgggcagatcctgtgccactacaactacaccgtgaacgagacgacacacgactgcggcgagatcgacggtctcgcgcagagccggaaagcgacttatcaccacccggcgagcggtttcgaagcatcaatcaccgcgcgaatgccgaggtagcacccagagcatccgtcccactgcctcggcctggttccgggtgtgcgtcttctcgtagatcgcgcgcaactgggtgcgaatggtcgcgagcgacacgcccgcgctggccgcgcattcgtccggcgtcttgccaccgatcaacgcctcggcgacggcggcttccgcgctcgacaagccgaacgcctgtcgtagctgttgcgcggcgacgagcggcgccccgctacgttgcctggccgtgacgagcagcgtcgcatcgccgagaacggcatgccgcccgtgtccggacaaggcggcgatgctcagaaagacttcgtgcgcggcgttcacggtgctggacaaggccagactctcgcttttgcgggttttcgcgacacgccccagcgccgccttgagcgcgtcattctgaggcgcacttaccgcgccaagatgaccgttctcgagcctgatccaggtggccgcgcggagcatcgcttcggccgccctgttgacgaacacgatgcgtgcatgccggtccagcgcgaagacggacaggcccagttcctccatcagttcggtaccgagtgccgcatcgtgatgcagtaccctggcgtcctgccacaggttgatcgaacgttgcagatgcccggccatgccggtcagcgtcgcacgctcttccggtgaatagggcgggcgcccgtgcgcgcgcaacagcccgagcaagatgttgtcactaccggggcgggcgaaccgaatgcccatcagatagcgaatgccggacggaatctgatagtcctggaagaattcgctgcgttcgatatcgcgctcggtcaggtgatcctggcagcaaacgaattcgcctagcggtgcattctccacgaagcctcggcgtggatcgagcgcgccgtaatactggtcgtagagcgcgacgatctcgtcgaattccgcgcgcggagaataaatcgagaatttcggcgcattgcgtgcggcgtcccaactgaacatgtgaaatacatttgcaccgaggctttcggatacccggtgaaagacttcgagaaaaccatccggatgcagcgcggcctcgtagaggtccccgatgagttggtcacggtgcatgctcccccgtcgcttcgcgatcttcgtatgttgattttgtctgacgatattgcttcgaataccgaatgttttcaggctaacacaggttatttgcatgcagtgccatgttgtttcctgattttcatccacctgaatgatgatcaaaaaaatggctttgcgagaatcccggccattcagcgtgcatgagcagtgcaaatggcacgtatcaaccagcaggctctcggggaaaaacaatgaagctcacacctgtcgtatccggtatcgcagtgctcgttctgtcggcttgcggcggcggtagcagttcgtcctcgtcgcctgccgaaccaacagcacagacggtcagcggggtcgcggccgccggcgcggcgatgcagggttccaccgtgaagctggtcgatgccaccggcaaagcggtagactgcccggccgatgcgtcgaccggcgcgtttcattgcaccgtaacgggcttgagcgcgccgttcgcattgtccgcgtacggcaacgtcgccgattcgcaagccacgctgatcgcgctcagcgcgaaagccggcacgcagaccatcaacatcacgccgatcacgaacgcaatcgccgccacgatcatcggcgacaacccgacgaagctgctcgccgacaccggcttgctgcagagcaaagtcaccgcgcaggcagttgcgagcaccgtgcaagcgtattcgtctgcgctatcggacctgctggccgcgaccggcaatacgggtgtcgacctgatttccggcccgctgaccgccggcgcaccgggcctcgaccggctgctcgaccaggtgaaggtcaacgtgctgccggatggcggcgtccagatcagctcggtggcaggcgcgtccagcgatacgccggtacagcttcagctagcaccgggtgtcgcgccgcaggccggcgacaaggcgagcctgccggccgccgcgaccatcaacggtgcggtagtgtcgaatttgccgagcgccagcgatctggccgcattgcagaccgcactcaaccagtgcttcgccggctcgaccggcaccgcgcggacgggcggcagcgtagcggcgtgcggccggatcttcgtggacgacgtcgcatcgagtgcgctgaacgccggcgtgccggctgcatatctcaacaacgggatgtcggccgaccaggagttcggtgcagtggcgggcagaacgccggggatcgtcgccgacgatgcaatgaacaacgccagcttcagcttgccggaagtcatccgcgtcgttgccggtgacacgatgtgggtcaagctcgcgtggacgcgcagtgacggcattcgcgacggcatgcagcagcacgtgcaactggcggtgcgggcgggcagtctcgcgagcggcgacaacggctggcgcgtggtcggcaatcagcgcgcggtattgagcaaggtgaacgcgaacgcgcaaaaatgggactggctgaatccggccaacccgtcgacgggaaccaatgcattcgtcgattcgctcaacctccaggtgggcgctgtcgatgcgaccggtaccgccgtggacttcgcgatcgtgaacggccccggcttgcgcaacggcgtgttcctgcagccgtcgagcggcacctgcgacaccttgaacatccgggcgcagatcgcgagcgggcagacgccggcgcagcttgccgcgctggcgaagaatgcgctgtgccgcaacaatttccgcctcgccggcgtcgcgcaggatccggccacccagggccagttcacgtggcccggcgacgcgccgcgcaacaataccgcgtgggcgaaaccgcaactgagtgccgccgagctggccgacatcaagccgttcagcgcctatacgatcgacgtatatcagaacggcaacacgtcgacaccagccaaacactatacggttcgcttgcgtacgccgtcgccgcttcccgaagcgctgcgccagtacgcctggcacgagctggcgcaatccacgcgcgacaagctgacgccgggcaccgccgacacattcgtgggcggcacgacctttccgctggcctggacgtcgaaagccggactgccgttcgtcaagcgcagcaacgtgcagattcgcgcaaccgcggccgggcagacggcggcgacgttcgtcaatggttcggcatcggcgttgccggtccagccgggcgctgcggtgacgctcaacgtgccgggcgaccagggcgtggcgtttccgtcggtcgccggctggaccggcagcacggacttctcgttcgtgaatttgaactggtccgatccggtcgacacgctctttaccgagtccttcgagtacgaccggtaacgggaggctcaaaatcggcgctcgctgacagtcccgtgcatgccggatcaccttggtcgtgtccggctgcgaggaaagcggcgagcgtcgcgtcgaacccggctccgtgtcgtcgagtagcgggatcgcctcttcccgagccgtacgaagacggcgagcggacattccgtgacgcgatgcctcgcgcccggcccacacgtgatgggtccaggtcaccccggacaggcgacgagcattcgcagcatttccggtacgacagaaacgactcgaagccatgagtgccgccgacctcccctcgcctcgctcactggccgcaatgacctgcgcgaatacaggtcaaaccgatagccgccgataaggcgagctatcgcagaaacggtgccaacgcttcggaagcttcggagaactgcttttcgaggaagtcgagcagtgtgcgcacgcgcggtgccatataaagcgtgcgttgaaagagtgcgttcacgggtacgtccgggcaacgccactccggcaggagcagtttcagccgcccggcctgcagatctgcgccgatgtcccagatcgacttcatggccacgccacgaccctctatcgcccattcgcgggcaagcgaaccgtcgttcgtttgacgtgaactgtcgagcggtgccgtgaacaatgctgtctcgccgtcgcgcgcgaaacgccagttgttcgccgcgcccgctgccgaagaaagtacgacgaaccgatgttcgcgcaaatcgtcgggatggctcggcataccgtgcgcggcaatgtagtcgggcgacgcacatagtgcacggcgattgtcggccatgcgcttggcgaccatcgaactgtcggccggcacgccgaagcggatcgcgagatcgatgtcgtcctgcagcaaatgtgacagcgagtcggacaggaccagcgtcagcgtgacgttcgggtggcgttcgttgaattcgtcgagccatcgacgtagcacggtgcgtccgaaatcggaggtagccgacacgcgcaacgccccactcaccgacgcccgtccggcctgcaatgcagcgcgcgcatcttccagggtttgcagcgcatgctggcaatgtacgaggtacaggcgaccttcgtcggtgaggcgcagcttgcgggtcgaccgctcgaacagctgagtatggagttctcctcgagcttcacgagccgggcgctcgccgcggcgggagagaggccgagctttctgccggcagccgaaagactgccttggcttgccgtttcaacgaagaggcgaatatcaccgagattgtccatgatcgcgtcacgcgaaaataatgatgggttgtgccgcgcgataccccgcgtgggccccggcatggtaacgcgatgcagatcgaatcaggaaaggccgaccggcgagatcggcctcatgcccatttacctggcgaccacgccgagttgctggaggaacgtcagattgtcctcgagatgccagttgtcggtgatcttgccgtcgcgaacgcgatagatgtccgtcgcgatgaagtcgaccgcctgcccctttccctgcacgccgttgaagctgcccgtgaagtgaccggtgaagtgcagatgggtgatgacgcggtcgcctgcgacgatcatctgttcgacgtcggcgtgaacgtccggcacggcgccatggaaacccttcgatgccgcgagtggccctgcgatgccctgcggccggccggcgggcaacgtgcggtcggtgaaatcggccgccagcgcctcgcgagcctgggcctcgtcacccgtgctccagaaggtatcgtaaaggcgtgccgcacggatctgttgctcggcctgatgcttcgacagactcttgtcgacaatcagcgttttcggctgcacgagattgtcgtcggtggcggaaacggcaggcaatgcggcagcagctgtggcggcggccaacgcgatgcgggaaacgacggaaacgacggtgctggttttcatgtcaggctcttttgcggtgtgctcgaaaaacgaaatgaatccggaaatgatgcggccttgaatattcaggcgggaatacgtgctgcgcgatcgcatcagtgcgaagccgctcgggcaataccctagatcgtctcgctttcgcgtaccgtaatcgggcttttcagtacgaaccgcgcaatgtcgtccttgcgcatgaacgcaacgccgggatggctcttcgcataacgcagaaacgcgtcccatgcacgtgtcatctgcggcgttccgctgatacggtcatgcgcgctgatcgacatcatgcgtcgacgcgatcccgcctcttcgtatagctgatcgaaatcgaacttgatctgttcgaggaatttttccggagagtaattccggccctcgaccagcaggatgtcgttattgcgcagtgtgtacggaaccacaacgaaatccttgccgttgaccttttcgatgaacggctcatcacggctcgtatcgtcgatgtgatagacgtaaccgagttcctgcagcaacgacagtgtgttcgggccgcgtcgcagccagttcgcgttatagccgatcgggcgttgaccagtcacctcttccaccatcgatcgcgcctggatcaggaactcgcgttcctgtggccgcgacatcgcgtactgcgagttccacgtcggcccgtggcccgacgcttcatggccacgcgccacgatctcccgagcaatctccggatgccgcttcgctgcctcgccgatcatatgagccgtcaccttcacgtcgtggcgatcccagagatccagcatccggggaatcccttcgcggtatccatacgcaaaccacgcttcggcggccagatcggcggggacactcgccgggaaatcgaccttcgggaacggattgtcggcccccttcggggctgcccgcccgcctcgaactgcatcgagattgaaatgaccagccgcgcgccgtcgggccagaattctccccgcccgggcgcagcgaccgcgttcgattcggaatgactcgtttgcgcgccgacctgtgccgtttgaagcatcgcaccgacggcgaaagcacccgcgccgacaccggccttggtcaggaaggaacggcgcgtcggctgatccggcgcccgattgactgaatcacgatccgtttgatcaacctgaatttccatagttgagctccacatgacgcacaagcgcgtctgcgtctatgtcaccgcgttgcggtgcatgatgacgaatgaacagaaattgaatgtcgcgccaaaccgtgcgcgtgggattaattttcggcaaacgcccatattttgaaaatgggccttgaaatgaatagactttcaatccagacgaaaaattcggatcccaccgagacaggtcaggcaaactcggcatgcgtctcttcaatgcctcgccacccgccgataaatcgcggtgagtaacgcagccgccaaggcactcagtgccagcaacatggtcggcccgatcgcatcgtgatgacggtctttcaaccacccgaacgcgatcggtccggcgaagcccgcaaggtttccgaaacaattgatcgtcgcgatcccgctgccgcggccgtgccggtcaatcgcatggtcggcagatgccagaacagaggcaatgcggtcagcgtgcccgcagcggcgagtgaaagccccgcgatcacggccggcagagcgccactgaacgatgcgctcaaaatgaaaccaaccgatgccacaccggcgccgcctacgacataggccgcccagttacccgcacggtccgcgctacgtgctccgacattcatcgccagcaccgcaatcaaatacggaatcgcactgcaaacgccgatccatgacagtttcgtcagacccgtgtccttcacgagcgtcggaagccaaaagccgattccgtacagaccgacgagaagcaggaaataaatcgtcgtcagcaacaccatctccgacgccgacaatctggatgcgcgctgcgtctcctcggcacgacctgcattgacatcgaggcctcgcaacaccgcatccgcctcttccggcgacagccagcgggcatcgttcgggcggctcggcagcagataatgcacggcgagacccacgacgaccgtcggcaagccttcgattacaaacgtccattgccatcccgacagcgccgcgaatccgtcgagattcgtcatgatccaacccgacagcatgttgccgacaatgcctgcgaccgccgtcgcgctcatgaacagcgtcgtcatccggccgcgccggtgagcaggaaaccagtaggtcagatacagcacgatgccagggaaaaatccggcctccgctacgccaaggatcaaccgctgcagatagaaagtggcgggagaatgtacccacgccgcagcggccgaaacgataccccaggtcaccatgatgcgggcaatccacacgcgcgcgcccacacgatgcagcatgaggttgctcggtacctcgaacaagaaatagccgacgaagaatatccccgcgccgataccgtagacggtgtcgctcaacccaagatcacctgccatctgcagtttcgcagccccgacgttaacccggtcgagatacgcaagaacctgagccaccagaagcaacggcatcagtttccaaccgatgcgtcgatatagtgcgtcgagatccgcgggcgacgagtctgccgggattgctttccgttcgtcgggcgtctcacgcccggtgctgcgcatgatgtccatttcagtctccatgaattgttgttgatacgtgccacgtcatgcagaagcacccgtctcggcgtgggtcccgtcacgaacggtcttgatgtacggcgcgccgctgaaatcgcagacgagtacgcagcactgccagccgaacgccggctggatacgctcgacgtcgtctcgcacgacgtcgtgaatcagtctccccatttcgtgcagtaccggctcgctcctgggtttcgtcagcagcagcctgacgacgacgaattcgtttgtcggatcatctccggacaagaactgctcggccgtataggtgcggctcttcaattcggatagcaaagcatgcccttgtgccgcgagccgtttgtgcaacgtgcccgttaaggatcggaaatcgatcagtcgcgcaatcccgggcgtggattcgatgatcaggtgcggcatgtcttcacctctgttgaaagaatgcgtgggtgagaggttaggattcggatcacctgatgtaaattaatgtttttcgcatcgattcattagcccttgttatgtattcagccatcgatcttcgcctgcgcagcttcattgcggtcgcacgctcgggcagtgtgacccgcggggcagcccgactgcatttgactcaatcggcactctcgcagcacctccgtgagctcgcggatctgctcggcgtgacgttgttcgatcgggtgggtcgcggcattctgctcactcaagcaggtgcggacctgttcgcggaagtcgagccgatcctggaaaagctcgatgtgacgcttgccagcgtccggaaccgctcgctcgaagttcatggcacgttgcgcattggtgcgatcgacacctacgcaagatcgctcgtgataccgacgatatcgacgctactcgcccggcattctcagctgcgcgtgtccgttcacgaactcccggccgcggcgatcgatcaagggctgatcgaaactgaactggatatcggcgtgtcgttctctcacttgtcgaatgcggacatcgagcagagaacgttgttcacggaacggctggcgctcgtccggcgatccaagcgtcgcagggccggaaagaccgtcagcctgcaggaagttgcgccccagccgctcgcgctgctgaatcggacattcgccatgcgcgggcaaatcgacgccgcatgcgcgagtgcaaacattgcgctggacgttcgcgtagaggccgccaatgtcgattcgctgatacggctcgtcgagcatgccgactacgcaacaatcgcgagcccgctggcagtgcaggccggctcgcgaatcgaaacgacgactatctcggacgacggcctggcgcgcatcgctgcgttgcgctggcgccgcggcaggacctttacacccgccatggaacgttttgaagaagcgatgttgcaaacgattcgttcgtctggcctggaaacgccagacgacgattcggtaagcatgtcggagccgtcccgccgtccgcatattcgacagcgctgacggcatcctgaacacgcctgtggcgtagacggaacggctgctcatgaggcggatactcccttcgccccaactccggacggacgtgagcgattcacgaaggagttccgctaaatcgcggacgcgcggtaccagcaagcggccgtaaaggaagatcacgcgcaacggcgcggcccgtcaggtccgatgaagttttgggttcaccggcacgcgtcccgacgcagcgtactacgcgatcgcgccaccaccgtctaccaacaccgtcgaacccgtcgcataaggggtcgacgcaaggtagagcacggcgttcgcgacgtcctcgggttgtccaactcgaccggccggcaatcgcgccgccgcgctttcgtacatccggtcgcgtgcttccgcatcgatcttcgaccagagaggtgtcgcaatcaggcccggagataccgtgttgacacgtaccggagcaagttcaagcgcaagtcctctcgccaacgattcaagcgctgcgttgatcgcgccttgcaagaccgaattcttgctcggccgcacactcagaaagcccgacacaaacgtcagggaaccaccttgccgaatgcggacggcccgtgcgatgcgatacgctcccagaacttgctgtccatcgccgcgtaggcgtcgtcaagctccagaccacgcaccggccccgtggctgtctgggcggccgatacgacaacgtggtcgaattcgcccgccgaatcgagaaatgcacggacgctcgcgtcgtccgtaatgtccatcaagccggtgctcacgccaaaaccgatcctgtctttgctcgccgccagcctggccgcatcgcgcgatgcaatcgtcactgtcgctccggcctccgcaaatgcacgtgcggtcgcttcacctatcccggagcttccgccaaccaccaacaccctttgatcattgagtttcatcgcccgtttcctccgttaagaatctgtccttcgaacaccaccgccgatggcgcgaccggcaacgcaccatcgtggaaagccggggcgacatcctgcctgcatgccagagctgtaaaagatgcgcccctccctctgcatgcaccgcctctgtcacgttacgccggccttcgatctgcgcgcactgtgaatacccggcgtaaacgcgtaacccttgccttgcggagaaatctgcgtggcttcggttacgatcagcgccgctgacgcgcgttggctgcggtcggcaaatcgcctggccggttcaagtattcttgatatcgccttgatcattggatgcgagtgccgtcacgaactcgacgcaaacgcccggagcaatagacacgaacagctgtcgctcgttggacaacggcacgtcgctcaatgtgtagtcgatccgcctggtggtcagccgctcgatcaacgcctcccattcgcgacgcgcgtcgatgcgcagcgcaatatgatcgatacgcggagcgctacgacctttctgcgcaggaagcgtcgcgcgcgtaacgtgaatcatcgggtgacgatcgagatacaaccaatagccgtccacgctgaacggcggtcggggcccggtatcgagaccgacaacctcatcgaaaaagcaacgggtaccgtcgatgtcatcggtaacgatggtggcgtggtcgaaatgcatggctcatgcctgtacgagggtgcgatgttgtattttgttgccccggtcgatcttgataattggcttcgcgattgaatgattttcaacgatgacaagaagatgggaagtgcatgtttccacgctcccgatcagcctggtcagtgaccgagaagattcaggaagatcaacagaaaatgaaaacgggtgcagaccacggtctgcacccgttacgccccttccgcatcccggtataccccatcatgaatcggtggtgactgtagggcgacttcgtcaccggatcggctgcggtgatcaagccgggattgctcatcccggtgtgattcgcgacctcggtcagacatctcgcgtatcccggtacggttcgatcggcaagccaaagtccggattccagcgcccccaaccaaacaccccagacttcacgattcatttaactttccgtgaggacttcgacaccggccgctgactacgatgggcgcatgttttcaggacctgctgccaggagcccatcatgcccacccgcagacatctgctgttcgccggcgccaccggcctcgccgcgcttgcgaccctgtcgtccgtcggccgccgcgcgctggtcggccgcgcgttcgccgcgccgccggccaccccgcagacggccgcgcctttcgaagtcaccctcagcgacgccgaatggcatcgccggctcacgcccgcccagtacacggtcctgcgcgaagccggcaccgagcgcccgtacaccagcccgctgaacgacgagcaccggcacggcacgtttgcgtgcgccggctgcgacctcgcgctgttctcgtcggccgccaagttcgacagccatacgggctggccgagcttctggaagccgctcgaccacgcggtcgccacccacaccgacgcgtcgttcgggatgatccgcaccgaagtgcactgccgccgctgcggcggccatctcggccacgtgttcgacgacggcccgccgccgaccggcctgcgctactgcatgaacggcctcgccctcgccttccaccctgccaccgcctgatccggccccacgcctgatcgactggagaacgcaccatgctgctcatcgtccttgcctacctcggcggcgtgctcacgatcctgagcccgtgcatcctgcccgtgctgccgttcgtgttcgcgcgcgccgaccagccgttcgtgcgcaccggcctgccgctgctggccggcatggccctcacgttcgccgtcgtcgcgacgctcgcggccgtcggcggcggctgggtcgcgcaggccaaccaggccggccgctgggtcgccatcgtgctgctcgcggtgttcggcctgacgctgctgatgccgcgtctcgcggagcacctgacgcgcccgctcgtcgccgccggcaaccgcctcaccggcttcgcgcaacgcgacggccgcccggccggccccgcgtcgtcgctgctgctcggcgtcgcgaccggcctgctgtgggcgccgtgcgcgggcccgatcctcgggctcgtgctgaccggcgccgcgctgcgcggcgcaagcgtcggcacgacgctgctgctggtcgcatatgcggccggcgcggcgacgtcgctcggcgtcgcgctggtgatcggcggcaaggtgttcgccgcgatgaagcgctcgctcggcgccggcgaatggatcaagcgcggaatcggcgcggcgctgctggccggcgtcggtgcgatcgcgctcggcctcgatacgggcgcgctcgcacaactgtcgaccgtcacgacgagcgggctcgaaacgaagctcgtcgaccgactcggcgggcatgcgagcggcgcgccggtcgcgatggccacggccggcggttcggcggagaacgtagcagaacgcgcggcggacggctcggccaacggtgccgcgaacggttccggcggcgcgatgatggccgcgacagccgatgccgcgcaggccggcggcgcgatgatgcgcgcggtggacgcgacgcatgggccggccgcgctgcccgtcgaaggcacgctgccgtcgctcgacggcgcggtgcagtggctgaactcgccgccgctgacggcggccggcctgcgcggcaaggtggtgctggtcgatttctggacctattcgtgcatcaactgcctgcgcacgctgccgtacacgaccgcgtgggcgcgcaagtacgcgccgtacgggctcgtcgtgatcggtgtgcacgcacccgaattcgcgttcgaacgcgacatcggcaacgtgaagaaggccgtgcacgacctcggcatcgacttcccggtcgcgatcgacaaccgtttcgcgatctggcgcgcattcaacaacgaatactggcccgcgcactacttcgtcgacgcgcaaggccgcgtgcgccgtcaccacttcggcgaaggcgagtacgcggaatcggagcgcgcgatccagtcgctgctcgccgaggccggccatccggaagcgctgaacgtgccgctcgggctcgccggcgcgcccgcgaagggtgcgctcgcggcggccgacagcgcggacgtccgctcgcccgagacctacgtcggctacgcacgcgccgaggatttcgtgtcgcccggcggcgtggtgcgcgatgcggcgtttcactatgccgagccggcccgtcccgatctgaacgactggggcctcgccggcatgtggcgggtcggcgccgaacgcgcgacgctcgcggcgcccgccggccgcatcgtctaccgcttccatgcgcgcgacctgcacctggtgctcggccccggcgaggacggcaagccggtgcgctttcgcgtgacgctcgacggcgcggccccggcgccgcgcacggcagcgacgtcgatgcgcaaggctacggcaccgtgaccgggcaacgcctgtaccagctggtccggcaacccggcgcgatcgccgatcgcacgttctcgatcgagtttctcgatcccggcgtgaatgcctatgcgttcacgttcggctgatcccggccggggcggcgcaccggcgccgcatccgggccccgctttccattccgccttccgaaggagcacaccgtgaacaccacctcccccgcggttccgcgccgcaacggcgaaaggcgatgctgcgccgcatcggcgccatcgccgtcgcggctctcgccgtgttcggctaccagcgcatcgtcaactccgccgaggcgatgcgcaccgtacccgcgcccacgctcgacgaaacgcccggcacatcgcacgacgagacggccgtgttcgccggcggctgcttctggggcgtgcagggcgtattcgagcacgtgaagggcgtgaagcaggtcacggccggctatgcgggcggtgcgtccgaaaccgcgcactatgcgctcgtcggctcggggctgaccgggcacgcggaatcggttcgcatcgtctacgacccgacccggatcacgtacggccggcttctgcaggtgttcttctcggtcgtgcacgatccgaccgagctcaaccggcagggccccgacgaagggtcgcaatatcggtcggcgatcttcccgaccaccgcgcagcaacgcgcggtcgcgaccgcgtacatcgcgcagctcggcaccgcgcacgtgtttccggcgccggtcgtcacgcgcgtcgaggactacaaggggttctacccggccgaggcctaccaccagaactacctcgagctgcaccccgacgcgccgtacatcgcgtacaacgacatgccgaagatcgccgggctgaagcagtacttcccggcgctgtaccgcaccgacgcggtgctgtggcgcgatgcgcgctcgtgaccgccacgcggtcacgcggccgcgtgacggggtgacggggttgaccgggtaacgcccgccgcgcggccgaagcccgtgcggccacgcacggccggcgcgagccgcccgcgatccggtttgcgctgcatcaacgaaaccgcgggcgccgtgccggggcaaacccgcatcgcgtccgccgcgaccggcaacttcgcgtagacttctccagatccccgccgcatcttgcggcgcccggaattccagtccagcccggagacgtcacgcatgcgagcagtgcccttccctgacagcggcacccttggagaaccctcttccggctcggccgtgcgcgacttgcgccgcgtgccgattcatcccgattactggtacccgctcgcgtggtcgcgcgagctgaaacgcggcaagacactcggcgtgcgcttcgccggcgatccgatcgtgctcgtgcgcaccgaatccggcgccgtgtacgcgctcgaggatcgttgcgcgcaccgccaggtgccgctgcacgcgggcgtcgtgagcggcgagacgctgcgctgctgttatcacggctggacctacgcgtgcgacagcggccgctgcgtcgacgtgccgtacctcggccgcgagcgcctgcccaacggcgtgcgcgcgtatccgtgccgcgaagcgcacgggttgatcttcgtgttcccgggcgacgcgacgctcgccgactcgcggccgttccccgcgctcgaatcggcggacgaccgcgcgttcaagacgcgccgcttcggccgcgaggtcaagtgccactactcgttcatgcacgagaacctgatggacatgaaccatcagttcctgcatcgcaagcagatggggcagatgcgtgcgcgctcggtcggccggcgccgcggcgacgactgggtcgaggtggactacacgttcgcgcggatggaaggcaagcagccggtcggcgaggcgctcgtgttcggcgcgagcaagaagccgggcgagcaggcggacaagagcgtgatgacggtgcgcaccggttatccgtaccagacactgcagatccgctcgagcgaaggcacgctcgtgatggacctgtggatcgtctatgtcccgctcgacgccgagcagcgcaccaaccgcacgttcggactgctgtcgatccacaagcccggcataccgttcgcgctcgatctcgcgtggccgctgctcgtctggttcaccgagcgcatcttccgcgaggatcgctggatcgtcgagcgcgagcaggaagcgcatgaccggcagggcgccgactggaaccacgaggtgtttccggtcatcaacgagttgcgcgacctgctgcgccagtgcggcgcgcgcacggtgatcccgatccgcgaagcgcgcgacggcgcgtgacgtgagcggcgcgccggcgcgcgcgccgttcgttacaagcggaacgcgcccggcagcaatgcgtcggccgtcgtgacgctgacggccccgtgcaggttggccaggatcacttcgatgtccggcgtgccgatctcgatgatcacctggcggcaagcgccgcacggcgcgatcgggccgtccgtgtcgcccacgaccgcgagccgcgcgaaatccctggacgatagccggcggcgatggccgcaaacatcgccgtgcgttccgcgcagttgcagagtccgtaagacgcgttctcgacgttgcagccgtgaaaaaccgtcccgtcgcgcgccagcagcgcggcgccgaccttgaagcgggaatacggcgcgtacgcgcgttcgcgcgccgccttcgccgcttcgatcagttcgtgtcgttccatctcgtcgtgcctccgattgtgtgccggggcgcatcggcgcggccgcatcccggccgccacgatacgcccgtggcgtgaagcgatcgccggtatccgcaccgtgcgatcggtcagccgatccgctgatagagggtcggcggcgcgtcgcccgtctcgcccagcacgtagctgcgctggatcgcatccaccgcgtgcgccgcggcggctgcgtcgcgggcatgcacatggccgagcggctggccggcttcgacacgctgcccgatctccgcgagcgccgtcaggccgacacggtagtcgatcgcgtccgccgcgcgcgtgcgcccgccgccgagcgcgacgaccgcgagcccgagcgcgcggcaatcgacccgctgcacgacgccgctcacgcgcgacggaaccggtacgatcacctccgcccgcgcaagatgacgcgcgggtgcgtcgatcaggtccgcggggccgccgagcgccgtgaccatcttcgcgaagcgttccgccgccgccccgaatcgagcgcgtgctgcaacttcacgcgcgccgcctcgacgtcgcgcgccagcccgccggtgacgagcaactccgccgacagcgccatcgtgacgtcatgcaggcgcgccgggcgcgatttgcccgtcaggtagtcgatcgcgcacgccacttcgagcgcattgcccgcgcacggcgcgagcgactggttcatgtcggtgaggatcgcggtcgtcttcatgccggcgccgttgccgacgtcgacgatgctgcgcgccagttccgccgactgttcggcggtcggcatgaatgcgccggagccgaccttcacgtccatcacgagcccgtcgagcccggccgcgagcttcttcgacaggatcgacgcggtgatcatcgcgatcgattcgacggtcgccgtcacgtcgcgaatcgcgtagatgcgcatgtcggccggcgccagccgcgccgtctgcccgatgatcgcgacgccgacctcgcgcaccgtgcggcgaaacgcgtccgtatcgggcgtcacgtcgtagccgggaatcgcgctcagcttgtcgagcgtgccgccggtatggccgagcccgcgccccgagatcatcggcacgtagccgccgcacgcggcgaccatcggcccgagcatcagcgacacgacatcgccgacgccgccggtcgaatgcttgtcgatcaccggcccgccgagatcgagcgcgcgccagtcgagcacgtcgcccgagtcgcgctgcgcgagcgtcagcgcgacgcgctcgtcggtgctcaggtcgttgaaaaacacggccatcgcgaacgcggccacctggccctcggtcacgctgccgtcggtcacgccgcgcacgaacgcggcgatcccgtcgcgatcgagcggctgcccgtcgcgcttccggcgaatgaattcctgcggtaaaaacatcgttgcctctcctcgatcgttcaggttcaggcgcaagttcaatggagcgaaaagaacaggcccgcaatcgccgcgctcatcaggttcgacagcgtcgcggccgtcagtgcgcgcaggccgtgccgcgcgacttccgagcggcgctcgggcgcgaccgcgctgaagccgcccgcgaggatcgcgatcgacgagaagttcgcgaagccgcacagcgcgaacgacacgatcgcgagcgtcttcgggtcgagcacctgcaggccggccgccgcgacgtgctcgccgctcttcaggtacggcgaaaggtcgccatacgcgacgaactcgttgaagatcagcttctcgccgatgaagttgccggccagtgccgcgtcgtgccacggcacgccgatgatccacgcgagcggcgcgaacaggtggccgatgatacccacgagcgtgatctgcggaaagcccgcgaacgccgccgcgccgctgacgatgaggttcatcagcgcgatgagcccgacgaacgcgatcagcatcgcaccgacgttgatcgcgatccgcagcccgaccgacgcgcccgacgccgccgcctcgatcacgttggcggcgcgcttgtcgtcgaaatcgagcccgtcgaccacgacgcggctcggctcgaccgtcggaaacagcagcttgccgaacagcaggccgccgggcaccgccatgaacgatgcggcgagcaggtattccatcttcacgccgaggccggcgtagccgaccagcaccgagccggcgaccgacgccatgccgcttgccatcaccgtgaagatctcggcgctcgtcatgttccgcacgaacggcttcacgagcgcgggcatctcgctctgccccaggaagatcgtcgcgacggccgagcacgcctcgatgcggctcacgccgagcactttcgccagtgcggcgccgaggatcgcgacgatccacttcatcacgccgatgtagtacagcaccgcgatcagcgcggtcacgaagatgatcatcggcagcacgcgcaggccgaacacgaacccgccgtcgccgaacagctggaacatcttgctgtcgacgagcccgccgaacacgaacgcgatgccgtgattgcccatgtcgagcacgcgattgacgccgttcgcggccgccgccagcgccgtgcggccggacggcacgaacagcaccagcgcgccgatcgccaactgcgtgcacagcgcggcgatcatggtcctgccgctcaccgcgcgccggttgttcgacagcaggtaggccaccagcagcaggaacagcatacccaggagactgcgcagaatatccacctcgtactccttgctctcaatgttgttggactgttcggcgggcaggcccggcatacctgcgaaaacgccgtcggtggatattactcgccggcatgcacgccgacaacgcaaacaaaatggccgcgttcgagcaacgtcgcgtgcttcgtcgacttgctcagttcttctacataccgggagatcggcaagacgggatcacgctacgatccgtcccaaatactgagagaattggcgggatggtgagcaacaaacagaagcggtgccggtatgcacgggaaggcaagaggaagcatgcggggcgtgccgctcgacccgacacgccccgcacgttacgcaccgttcagccggcgcgctcgaccggatgcggttcgcgcagccggttcgcgatccgcgcggcctcgtagtagccggccgccggcggccgcttcaggtagcggcccgcaccgcgcaccgcgcgcaattcgccgtcggcccatgcgagcgcgccgcgcgtgagcgtatgcgtcgcgacgccctgcaccgtcatcccctcgaacacgttgaagtcgacctgctggtgatgggtcttcaccgagatcgtcttcgtcgcggcggggtcccacacgacgaggtcggcatcggcgcccacctgcacggcgcccttgcgcggatacaggttgaagatctgcgcggcgttcgtcgacgtgatccgcacgaactcgttcggcgtgatgcggccgtgattcacgccgtgatgccacagcaccgacatacgatcctcgacaccgccgcagccgttcggaatcttcgtgaaatcgtcgcggcccatcgccttctgcgacgcgcagaacacgcagtggtcggtcgccgtcgtatgcagttgcccgcctgcagcccgcgccacagcgcctcgcgatgctcggccgagcggaacggcgggctcatcacgtgcgcggccgcgcgcgtccagtccggatcgcgataaacggcctcgtcgatcaccagatgccccggcagcacctcgccgaacacgcgcagcccttcgctgcgcgcgcgcgtgatcgcatccaccgcgtccttcgcggagacgtgcacgatgtacacgggcacgccgagcacctgcgcgatgcggatcgcgcggttcgcggcctcgccctcgacctccggcggccgcgacagcggatgcgcctccggtcccgtcatcccgcgcgcgagcagcgccttgcagctggaacacgagctcgccgttctcggcgtgcacggtcggcagcgcaccgagttcgagcgaacgcgagaagctgttcacgagcacttcgtcgtcggccatgatcgcgttcttgtacgccatgaagtgcttgaagctcgacacgccgtgctcgcgcacgagcgtacccatgtcgcgatgcacgctctcgtcccaccacgtcacggccacgtggaagccatagtcggccgccgccttctcggcccagccgcgccattcgcggaacgcatccatcagcggctgcttcgggctcgggatcacgaagtcgatgatgctcgtcgtgccgccggcgagcccggcggccgtgcccgaatagaaatcgtcgctcgcggtcgtgcccatgaacggcagttccatatgcgtatgcggatcgatgccgcccggcatcacgtactggtcgtgcgcgtcgacgacgctcgcgccggccggcgcgtcgatctgctcggcgatctggaggatcgcgccgccgtcttcagggtccgcgcacagaacgtcggcgcgataggagcggtccgcatcgaccacggtaccgccgcgaatcaggattgccatggggttgcctcctcgttgactgtcgggtgccgcatcgcacgcatcaagcgcatcgcgcgtgtcatgcgctcgcgatctgcgcgcgctgtccggtgcgccacttcatccaggtgccgtacacgcccgacgccagcacgaggccgacgaaccacgcgtacgtgtaaagcgtgttgaagaacgccggcacgttcgggaacgacgccggaaatgccgtgtgcaggaagccgggcaggttcggcagcacgccgaccgcgagcgcggccagcgcggccgggttccagccgcgcgcgtagctgaagccgccgcgttcgtcgaacagcgcgcgtgtgtcgagccgcgtgccgcgaatcaggaaatagtcgaccatcatgatccccgccacgggcccgagcagcgccgaatagccgacgagccaggtgaagatgtagccgtccgtcgtcgcgaggatcttccacggcatcatcacgatcgcgatggtcgcggtgatcatcccgccggtgcggtacgagatcgccttcggccacaggctcgagaaatcgtaggccgggccgacgagattcgcggcgaggttgcagcacatcgtgtcgagcgtgaggatcacgagcgcgatgcccacgccgatgcccgtcatccggctcgtcaggtcgatcggatcccagatcgcgttgccgtagatcacgacggtcgcggacgtcacgacgaccgacaccaccgacagcagcgccatcggcaacggcagcccgatcgactggccgatcacctggtcgcgctgcgaatgcgcgaagcgcgtgaaatcggggatgttcagcgcgagcgtcgcccagaagccgaccatcgcggtcaggcccggccagaaggtcgcccagaacagcccggccttcttgccgcccgccgcgaactgcgacggcgccgacagcatcgtgccgaagccgcccgccttcgacgttgcccaccacacgagcgccacgcacatcacgaccttgatcggcgcggaccagctctcgagccatcggatcgaatcggtgccgtgccagatgaagtagagctgcagcgcccagaacacgagaaagcacgcgagctgcccgaacccgatgccgatgaccggcagcgcagcgccgtgcagcgcgttgccggtcaggatgttcagcagcgtatagatcgcactgccgccgagccaggtctggatcccgtaccagccgcacgcgacgatcgcgcgcaacagcgccggcagcttcgcgccctgcgtgccgaacgacgcacgcacgagcaccgcgtatggaatcccgtgcttcgcgcccgcatgaccgatcagcagcatcggcacgagcacgatcaggttgccgagcaacacggtcgccacggcctgccacggcgacatgccttcctggatcagccctgccgcaagcatgtacgacgcaatgttcatcaccatcccgacccagagcgccgcgaagtgataccacttccacgtgcgctgcgccggcgtcgtcggcgcgaggtcgtcgttgtacaggctgccgccctgcgccgcggcgccatcgggatcggcgggattcgctgcgtgattcatcgaacgtactccgcgaaaacgtcggcgccggcaccatgcgtgccggcccgggtggaacgaaaagcggcggtgcggggctctcccgcgccgccggacgccggtcaggcagccttcttcgcgtgcttctcgggtgccgccgccgcacctgcactcgcccccgcgtccgcgctcgccggattgttcggatgcgtggtccagttcgcgtagtcgcccgaatcgacgcgctccatcgtgatgcattgctcgaccggacacacatgcatgcaaagattgcacccgacgcattccgagtccaccacttcgaagtgacgcacgccgtccttcgtcgccgtgatcgcctggtgcgacgtgtcctcgcacgcgatatggcacagcccgcactggatgcagcgatcctggtcgatgcgcgccttgatgtcgtacttcaggttcaggtatttccagtcagtcacgttcggcaccgcgcggccgcggatatcgtcgagcgtcgcgtagcccttctcgtccatccagttcgacaggccgtcggcgaggtccgacacgatccggaatccataatgcatcgccgcggtgcacacctgcacgctgccggcgccgagcaccatgaactcggcggcgtcgcgccacgacgagatgccgccgatgccggagatcggcaggttcggcgtttccgggtcgcgcgcaatctccgcgaccatgttcaacgcgatcggcttgaccgccgggccgcaatagccgccgtgcgtgcccttgccgtccacggtcggcatcggcgccatgtggtcgagatcgaccgcgacgatcgagttgatcgtgttgatcagcgacacgccgtccgcgccgcccttgtacgcggcgcgcgaccccatccggatatcgctgatgttcggcgtgagtttcacgaggcacggcagcttcgtgccttccttcacccagcgcgtgaccatctccacgtattcgggcacctgcccgaccgccgcacccatcccgcgctcgctcatcccgtgcggacagccgaagttcagctcgaccgcgtcggcgcccgtatcctcgacgagcggcaagatccatttccagtcccgctcgttgcacggcaccatcagcgacacgatcagcgcgcgttccggccagtcgcgcttcacctgcgcgatctctctcaggttcacgtcgagcggacggtcggtgatcagctcgatattgttcagccccgcgatgcgctggccgttccactgcacggcgccgtagcgcgaactgacgttgacgacgtgcggatcgagcccgagcgtcttccacacgacaccgccccagcccgcctcgaacgcgcggttcacgttgtaggccttgtcggtcggcggcgcggacgccagccagaagggattcggcgaagtgatgcctgcgatggtgcagcgaaggtcggccatgttcggctccgtgagagtggggtcgtgttcgttgtgctcgtggtggtatgtgacgcgcgcggtgcgctcacgcggccttcgcgtcgcgttgcgcgagcgccgcgtcgatcgacgcggccgcgcgcttgccgtcctgcacggcctgcaccgtgaggtcgatgccgcccgtcgccgcgcagtcgccgccggcccacacgtcgggccatgcggtgcgcccgtccgcatccaccgcgatacgcgtggcgtccgccgtcagcagcgcggctgcgccatcgtccggcaccagcgtctggccgatcgccttcagcaccatgtccgcttcgacggtgaaacgctcgcccgatgccgcctcgaactcgacacccgtcacctgcccgttcacgcccgccatgcgcacgggtttcgcgtgcgtgacgagcgtgacgccgctcttctgcgcgaattcgcgctcggcccacgtcgcgctcatcgcgtccacgccacgccggtacaccatcgtcacgcgatcggcgccgagcttgcggctttgcaccgccgcatcgatggccgtgttgccgccgccgatcacgaccacgcgccgcccgaccggcacgttatccagcgcgtcggcctgccgtacctgctcgatgaagtcgacggcgttcatcacgccgtccagttgttcgccgtcgatcgcgagcgcgcgcacgccggcgaggcccatcgcgagaaacaccgcgtcgtgctgctcgcgcagcgcgtccagcgtgatgtcgcggccaagcgcgacgccggtctgcagcgtgatgccgcccaccgacagcagccactcgacttcacgttgcgcgaaatcgtcgacggtcttgtacgcggcgatcccgtactcgttgagaccgccggccttcgggcgtgcgtcgaacagcgtgacgcgatgcccggcgagcgcgagccggtgcgcacacgcgagcccggccggccccgcgccgaccaccgcgacgtgacggcccgtgtcgggcgcgcgcgtgaagcgcaccgcgccggtcaccatcgcccagtcggtcgcatgccgctgcagcgcgccgatcgcaacgggctgcgcatcctggtggttgcgcacgcatgcgccttcgcacaggatctcggtcgggcacacgcgtgcgcacatcccgccgagcggattcgccgacaggatgtcggtcgcggcgcccttcaggttgccgttgccgatcttgcgaatgaagctcgggatgtcgatctgcgtcgggcaagcctgcacgcacggtgcgtcgtagcagtagtggcagcggctggcggcggccgcggccgcggtcggatcgagcagcggcgcgatatcggcgaattcgcacgagagttgcgtggacgacaggcgatgcgcggcgatatcgccggttggcttggtggtcatacgcgttccttcgactgggtggagacaaagccgtccccgccggctgcgaatgcacagtcggggcggtcatcattatcaggaatgctacggtcaggcggtacgcagcctgccggctgctacggtccttgcgtcatgaagccggctcgcatgcgcgcgacagcatcgcgtgcagcagcacgttcgcgccggcctcgatccatgcgggcgtcgcgtcctcgatctcgttgtggctgatcccgtcgacacacggcacgaacaccatcgacgtcggcgcgacctgggcgagataacacgcatcgtgccccgcgcccgacacgatgtcgcgatgcgagtagccgaagcggtcggccgcaccgcgcaccgcttccacgcatgcggaatcgaacgcgaccggcttgtaatagaaaatctgctcgagctgggtctcgagcccgatgtcggccgcgatgcgcgccacaccgtcgcgcaatgcagcatccatcttcgcgagcaccgcgtcgtccggatgacggaaatcgacggtgaagaacacgcgtccgggaatcacgttgcgcgagttcgggtagacctgcatcatgccgaccgtcgcgcagccgaacggcgcatgatcgaggccgatccggttgaccagatcgaccacgcgcgacgcaccgagcaacgcatcgcgccggcgcggcatcggcgtcggccccgcatgcgcttcctggccggtgaacgtgatctcgtaccagcgctgcccctgcgcgtcggtcacgacgccgatcgtcttgcactccgcttcgagtatcggcccctgctcgatatgcagttcgaacgccgcgtgcagcttgcgcccgccgcacggcacgtcgcccgcgtagccgatgcgcgccagttcctcgccgatcgtcttgccatccacgtccttgcgcgacagcccgtattcgagcgggaaaacgcccgcgaatacgccggatgcgaccatcgcgggcgcgaagcgcgagccttcctcgttggtccagatcacgacctcgaccggatgctcggtctcgatgccgtgatcgttgagactgcgaatcacctcgaggccgccgagcacgccgtagatgccgtcgaagcggccgcctgtcggctgcgaatccgcgtgcgagccggtaacgaccggcgccgcatcggccacgcggcccgcgcggcgcatgaacacgttgcccatcgtatcgaccgtcaccgtgcagccggcggccttcgcccagccgacgatcaggtcgcggccggccttgtcgagatcggtcagcgcgaggcggcacacgccgcccttcggcgtcgcgccgatcttcgcgacctccatcaggctgtcccacaaccgcttgccgtcgaccttgatcgacgtgtcgaaagctgcccgcttcactgtttccgataccgcgttcattcgtatcgctcctgtggggtcggtgatgtcgtcagcccggtctgtgccggtgcgtgcaatacctgtttcggggcaatcccgcccatgcgcggtgcatgtccggccgtgcgcgaagttcgtccgacgaatcgccggaactgccttccgccgctcgtcgaatcctgtccgattggacaggttttagacgatcaaaatgaccaaagcaatgtctttctttcgtggatcgatagagcgagaaacgtgccatcgcaacgcagcatcgctgcggatgcgccgtttccgcatgcgtgcgttcgacgcggatcagcggctagaatgaagcccaacgcggcatgcccgccgcgcgagggtaacgatgagacatgacgaggcggcagccgaagcgaccgacagcgacgaaacgtccgcgcctttgcggcgacgcaaggcacacatccgcgagtccaacgaagcgcatctgctcgcgtgtgcggaggccgtgttcgcggagcgcgggctcgacggcgcgagcaccgcgatgatcgcggagcgcgccggcttgccgaaagccaacctgcattactacttcccgacgaagctcgcgctgtaccgccgcgtgctcgacgacctgttcgaggactggcatcgcgcggccggcacgttcgaggccggcgacgatccagtggaagcgatcggcggctacgtgcgcgcgaagatggatctgtcgcgacggcgcccgctcggctcgaaggtctgggccaacgagatcatccatggcgcggagcacatgcaggacatcctgtcgcaacgcgtgaagccgtggttcgacacgcgcgtgaaggtgatcgacggctggatcgcgcgcgggctgctcgcgccgatcgacgcgcacgcgctgatgtacctgatctgggcaaccacgcagcactacgcggatttcgatgcgcagatccgcgcgctgagcggcaagcgtgcgttcacgcagaaggcgttcgacgagcagaccgagcaggtcgtgcagctcgtgattcgtgcatgcggggcggtgtcgccggaggcgaaacggtaggcattctcactaaggcatgcaccgcgcgacgacccgattcatcgcgccgccgacacatgcatcttcgcggggcggacggcttcagaacggaaccatctccaggacgtggctgctgaaccaatcggattcgttgtcgacgacctcgagcgagtcactcgggacttcgggatccagttccagttgcaaggcgagccggctgcccgtcgccggcttgccctgctccaccacgacgatgcccttgttcggatgcaggctgactttggcggcctgctccgaaggctgctggccgccatgctccacactgcccaacgcaacgggcctgccatccaggctcgcatcgccggccactatggaaagaacgcctcgcgaaccaaaccggaacgcgctgtgatccagcgcgtctccgcgcaggaaaatcgccatgcgaaccggatccttgcagacgacgttcacggcaatcaggcgttttcccaacgagcgtccttgcgccgatgcgggctgccccagaatggtctgccggtactgagcgccatagtccagctgcgcaggcaccgtatgcaactgacaattgtccgccgccgtatccgcggccgcggtgccggccaggctcaatcccgcgcacattgcccatgcacgccagctgaaaaaatctgttttcctaacatgtcttctattgagcccaggatctcattggagtgtgcaacgggcatcggcgctttcgaacagattgccagcagttgcttgctcgggcagcgcatactgcaaccggcactgcctgccgtccggcaatgccaccgtcaacgcatccgtgccggcgccgtcgttgagaaacatctgcccctgctcgagcaccgtgccgacatacttctggcggccatccagcacataggcgccagcgggcagcgggtttccctccgagtcgcgcgcgttgagcatcacccgacgcacgcgggtgagttcgaagtcgatccggttcaccgacccgcgtccggggtcgacctggtggaagccgttgccgatgtcgacattgcgcggcaacgtgctggtcatcacctccacacgattgctgctgtatggggaaagacgcggcaccacggcacgccccagaggtcggtccataccggcccctgcggggtgttgattttcacgttcgacacacccgatgccgacacgatgccgaacgtgtcctgcaccggatagggcgaaagcgtcaccccgttggcgtgcagcaccacgccgcccgaggccccgccgtaatacgagcgagcgcgcttgccggtatccgaaaaccccaggttgacttgagcaatgcgcgacgtcgcggccgcttgacccgacacggcattgctccggtcgcgcgtgttgcgctccgcattcagcgagtaattcaggcgatcgccgacccgttcgttgtagttggccccgaagcgcgtatagccgctcgtgttgctggcataggtgcggacgctgcgcttgccgaacgggatgctcagcgatacgtaataagtgttgtctggcctgtcgtaggctctgctgccgtaataccgggtgtctctgcgggggctgaggtcgcgctccacgttcagcgatacagtgccgaaggcgaagctcttgccccaggaaaagttgagccgctgggtacgctcccgttctgctggttggagaatgcgtagccgaacgtcaagccgcccagcctgaaatcggaccaggccagggtcgcggtatgccggctccggaagcgcgatgcggcgaacccgggctggccggcatccaaagtgaaatcgtccagcgtgcgatagccgttgctctggtacgcactgctgaaactcatggtcaggttctcgtgcaaaccgccgaaaatgcccgagacctcgatctgcgtgcccggcttcctggcctgcagtgacgcgcgctgctgcagcttgacgctgctcgaccgcgacacgcgcatatccacgccccaactggcggcctgggatccgggagcgaacagcgctgcggcgctgaggttgttgcgcttgcccagcgtccagctgccgctcgcgctcgccacccacgggttacgagccttgttgccgtcgagattgcggctcttgccgaacgcgaaagcgtagcccggccgctgtccgagcgcccccgcgctgatcgacgcggcgggcacgacgaagctgcgccgcgcgccgtcggattcgatgacggtcacctccaggtcggtgctgttgttgagcagcggcaggtcggtgagcgaaaacgggccgaccggcacgacggtggtatagatcaacccgcccgcctggcgcacctcgacgcgcgcctgcgattgcgccacgccctcgaccatgacgacgttacgctccagcttgcccagcgccgcatcgggaaacacctggatgccggtcagcggcgcgccggtcagcaccgagttggcgatgttgatctgtccggcctgcagcgtggcgccccatcgcagccaggttcgctggccgtacgcgtagaggtgtcggctctggaatcctgaattgtcctggcgctgcgaataggcgcggctgcgcaagatccagtcgccggcattcacgccgagttcggaattgagcgacaggaagttcgagcccggcatgccgctcgcttcgctgcgcatggtcatcaactcgtagttgaacagcgccgcattgccgccccggctatagccggagaaatcggccaccaccggacgaagcgccgtggtcggcacgacgagccgcacttcttcccgccccggcttgagcgccacgtccgtaccgggaaagcccgcgcgaagtcgtagcaggtgtcggggccggcatcgccatccaccgcgtatttcgcgtcgggcaccaccaagccgactgcgtccagaaaagtccggtcgaaacacggcgcgccatcgtcgtcgaagcgcgtattgatccgcccacgccgaatgtcgttgacgtagacaacgacgcggctacggccaggccgataacgcggcgcggcgcggaaataatcggcgatctgcggatccagcccgcgctgctgcaggatgctcgtgtcgaagttgaaggtcgcatcgacggacgccggatcggacgtggctggtgcggccgtcgcttgcgcggccgatgccgcgtcaggcggcgtggccgcctgcgcatacgcccgcggcggataggcaccggccagcagcatcaacagcgatgcggccgtcccgttgcgatacacgttcgattcgcgttggcgccgtactcggcgcgtggcacggtcgagccgcattacggttgcgtcgctgcgttgacgagcggggcgtcgtaggtgtcgacctcgtagccgtagatcgtcgcgggcgacagtttgacgccggttgcccgtacgccagctcctttcggcaacgagacttccacggtgctttcgggcagcacataggtcttacccagatccaccgctgtcttctccggcaggagttgcacaccttgccccagacgcaccacatacgggctgtcgttgcgcacgcgcagcttgccgtccgcgaccgaccactgcagcagcgtccagggcgaggtgtgcttcgcgagcttggccggatgaacgatcagcggcaggttctggcgaaccgtcatgctgatacgcgccctgccgtccgggcctttgggcggaatgccctcaaacgtcacgcgcttgagccgctgcactttcagcggcgccgggctttgcagcagaaaacgcaccagctgggtgtcctgaccttccacccggctcaccggcggcaccgccacgaccagcaattcctggtcttccggcgtgttctgtatggtcgtatgcagcagcagcggaatcgactccgtgttcttcacgttcatggtggcttcgccgtccgattcgttcaggatcaccacggaagattcgggcaggacgcccgaggcctgtgcaacggccggcatgctcaggcatgtcggcagtccaacagtcagaacggccttcgccactgcgtaccggcacgacgagaaagactggggacgggaagcaggccatgacgggaaatgccgggaacggttaaacataattagtaatccaacgcaaatggatttaataaataggaagggccgttacgcttggaacggcgaggaaattcgaggaggaggcggtgggatcgatcgctgcgtcggcctggtggcagacgccaggcgcgatattcgtgacgagtaggtgttacaggtagaacagctccaacgtggcggaaccgtcgatctcgagttcgtcggtgaacgcgatatcgtccctgaagtagaaccggaaccccaacccgctccccagtgtcttgaacgccaccggctccgtctgcggcccctccacgtcccacgcaacggtatagccggggtccaagccgacgtcgccactacccttctctccccaagtagtctccccttgctgcgccgaatcatgcggacgaacctcccatcggcgttgtgggcgtccgaaacaaagccgctaatgacgtagtaaccgatgtccggatcacccaggccgaatgcgtacacatgcactccagacggttgcgcaccggcgcgattgtcgatcacgtcgatcccgactttggtcgggtgctggcagttaatcagcaacggcatgtcgcgataaatctgctgatagccagcgataaaatccttgcgcgataaattacccagatcgatgacgcctccatttcccaacgctatgctgcaagccccgcgcgttcggatctgaccgttgacgctgagctcggcagccgatgtcacgcccgcgctcgacaacgtgccggccagcacgaaaaaacaaacaactgcttcaggctcatctgaatatttctcgcacgctgaaccgcacggacaaacacatatcggggcggcacgcgtaccgtcggataaccccgttccaacgccactgacagccacgctcattcccaacgcaccccgatccgattttcgtcgttgagctgcctgcgaaaatgagcgttcgagaaacaatacgccgaacgtcagccgtcagccgcccgggcccgctccgatcgcgcctttttacagataggtcagatcgagggtcgccgaaccatccagatcgacattgccactggaaagatccaattccgacaatttattgatcgtcggggtcgcaactagatggattgcgatggacttgtatgcgccgggcgtcaagctgcccgaatccgcaaacgatttgcgcgcgctgcctttcgccatcagccccacctcgtcggaagcccacgtgttggatccagccggtgcggccaagacattttccttcccggcgacgccgtcgagctccactatgccaatacccaacgtgtagtagccgaccttcccttgcccaggccgaactcggagtcttcgcccgagccgccggcggccgtacccgaacggttgtcccgcacgctcaatgcgaccttggtggccgaattacaggtgacggccacggtctgcaacttagcgtcgaattgcgtcgtcttattctggtgaagattttccgatgcgatggtgccgaaatcatagacaccgccgttgctgatcgtgaggttgcacgcagcatcgggcacgatcttgccggcgaccttgacctctgccgacgtgtccgcctgcgcatgaccagcaacgaccaacgcaccagcaaccagccccagtcctgcgagtttcttcttcatcgcgttattccaataaaaacgaaccaaaaacgaaggcccgcatcaagcgttgcacgtgccgatatcgggcaaaccgttacgccaccatgcggatacatcgaattccccggccctgttatctccaatcccactttaccgccacggtttgaaacatttcattctcgaacacaattagcctataagcagcctattccctgaaagagaaagctatgaaacgagaggtacgctacagatatacgagttccagggtcgcggaaccggcgatctccatctcgtcggtaaacgcaatgtctttgcccttgaaatagacggtgatcttcagcatgtcttgcatccacgtgcccgccaccgggtccgaaccgagtccaattccccacgaatagacattcccgcgacccaccgaccagccgccccaagaaggcgtgtgccaattgtcggcataggaacggcgaagcgatgtagctcgtttcccgttgactgcgcggtagtcatcgacactgagcaccatggagtacgaaccaatgtcaggattgctcagagcaaatgtctgctcgccctgatcgactgcactgaagttgtcggtcagcacgaacccgaccttggtcgggcgcgggcagctcacctgaaacggcaagcgcttaagcttatagtaaggcggatcaggaaaattccctttcgacagattgccgatgtcgacgatgccaccgttttccagcgtcaagtcgcacgcgccgaccgatcggatttgccccttgaaactaaggtcgacctggccattgaatttaagatccgctgccgacgccacgcccgcgctcgacaacgtgcaggccagcgcggaaagaacacaccactgcttcaagctcatctgaatatccctctcatttggaatggcatgggtaagccgtccacctgccggattgccatgcgaatcgttcgtcactatgcgcgtcgcgtcgacgatccgattcccccatcccgacgtgcatctctcgaaagcgcgatcacccgacgctcgcagtcacgcgacttctggcgtccatgcgttgacgccgctacgccgatttcggcccccgacgagcagcggcaatacaggcccgatgtctcatcacgcacgcatcggtcgaaagcaagcgctcgagaagaatgggcccgaacgtcagccgtcgcagccgtccgacgccccgccccactccggatcgcacctttttacagataggtcagttcgacagtcgccgagccatccagatcgacactgccgccggaaagatccagctccgacaatttgttgatcgtcggggtcacggtcagattggccgttacggtcttgtatgcgccgggcgtcacgtcgcccgagttcgcgaacgatttgcgcgcgctgcccttcgtcatcagccccgcctcgtcggaagcccatgcgttggatccggccggtgcggccacgatatccacaccgttgctgtcgccggtggcaccgcccagactcagcgtgtagtaaccggccttcccgttgcccagaccgaactcggcagcgtcgcccgtgccgccggcgaccgtgcccgaacgattgtcccgcacgttcaacgcgaccttggcggccgcattgcaggagatggacacggtctgaagcttgccggggagttgcgtcgtcttatcccggtgaagattttccgacgcgatggagccgaaatcatagacaccgccgttgccgatcgtgaggttgcacgcatcgggcatgatcttgccggtgatcttgatctccgcagaagtttccgcctgcacttgaccggcaacgaccaacacaccggcaacgagccccaatcccgcgagtttcttcttcatcgtcttactcccttactccaataaaaacgaaccgaaaaatgatggcctgcaccaaacgtgctaacaccgggcaaaccgttgcgccaccacgcggacaaatttactgcccggggtcaaaccaggtcattgggaagaatctgtttttcaccgagaaatatctgaccgaccactcagcccattcgccctcaatccgcattcaagtatggttagcggcacattcgcccgaacgacctcccgatgccgcgcacagtgccttctggaaaaccggttccagcccgaaacggcatcaaccgaaaaccgaaacggctgcgaggttatggatggtttgtttggctaaataaagatcaattgagcagagggtcccgtgaatcctcgtattgtggtcgtggacgaccatccgctgattcgaatggcggtgcgagcaattttggagcgcgacggttatgaagtcgtcgcagagtgtcataccggggtggacggtgttcaggccgctcgcacgcttgagcccgacttggtgatcctcgacctggtcattcccggtctggacggtttctcggtcatggagcgcctgcgcagcgccaagctcgcctccagcatcctggtgctcacctccggcgacacgcgcaattacgcgatgcgttgcctgcaagccggtgcgtccggctttgtctgcaaggacggcgggctgaacgaagtctccgaagccgtgaaagcggtgctttccggctattcgtacttcccgcgagtggtcaccgacatgcttcgcgaaaacctgcaggagatcgcaacaaacgaaggtagagccccgtcgcggagctcgatggactcaccgaccgggagatgacgatcctcggcctgctcgtcagggaatgaacaaccaggaaatcgggcgtacgctgatgctcagtcacaagactgtgagcacctataagatgcgtctcatgagcaaactcaatgccccgaatatggtcgagcttgtgaaggtcgcgcaacgcaacggcatagcgatgtcctaatcgctttcggaccagccgcttggccgacacgcgcgggaaagcgagcgaaggctcgattacgcgcgaactgctcgcgccgagcgacacgcgtgtgccggcgtatcagcgattcgccgaataatccgccgaataaaaacgggcgacgggtggtgcgcagggctccccgcgcaccacccgtcgcccacttcgcagcgtgcgtgcgaaacgttacgcgacccgctcgatcgcgatcgccgtcgcctcgccgccgccgatgcacagcgatgcgatgccgcgcttcatcccgtacgtctcgagcgcggccagcagcgtcaccatcacgcgcgcacccgacgcaccgatcggatggccgagcgcgcacgcgccgccgtgcacgttgaccttctcgtgcggcaggtcgagatcgcgcatcgcggccatcggtaccaccgcgaacgcttcgttgatctcgaacaggtcgacgtcgcgcaggttccagccggttttctccgacagcttgcgcagtgcgccgatcggcgcggtcgcgaacaggcccggcttgtccgcgtaggtcgaatgcccgacgatcacggccttcggcgtgaggcccaggcgctcggcttccgagcggcgcatcatcacgagcgcggccgcgccgtccgagatcgacgacgcattggcggccgtcaccgtgccgccgtcgcggaaggccggcttcagcgtctggatcttgtcgagtttcgccttgcccggctgttcgtcgattgacacgacggtttcggacttgccggccttcacggtcaccggcgcgatctccgacacgaaatgcccttcggcgatcgcgcgttgcgcgcgcgtcagcgacgcgatcgcgaacgcatcctgtgcgtcgcgcgtgaactggtacgcctgcgcacaatcctccgcgaacgtgcccatcaggcggcccttctcgtacgcgtcctcgagtccgtcgaggaacatgtggtcgagcacctgcccgtggcccatccgcatccccgcgcgcgccttcggcagcaggtacggcgcgttcgtcatgctctccatcccgcccgcgacggcgacccccgccgagcccgccagcaacaggtcgtgcgcgaacatcgcggccttcatccccgagccgcacatcttgttgaccgtggtcgcgcctgccccgagcggcagtccggccttcagcgcggcttgccgggccggtgcctggccctggcccgccggcagcacgcagccgaacacgatttcatcgatacgctcggccggcacgttcgcgcgctcgagcgccgcgcgaatcgccaccgcgccgagatcgctcgcgctggctgccgccaggtcgccctgaaaaccacccatcggcgtacgcgccgtgccaacgattacgatcggatcctgagtcgtcatgattcgcttcctccagtgtcagcgcggtgccatgcgcaacgcgccatcgagacggatgacttcgccgttcagcatcgtgttttcggcgatgtggcgcaccagcgccgcaaattcttccgggcggccgagccgcggcgggaacggcacgctcttgccgagcgcgtcctgcacgtcctgcggcatgccggccatcatcggtgtcgcgaagatgcccggtgcgaccgtcaccacgcgaatgccgaaccgcgcgagctcgcgcgcgatcggcagcgtcatgcccacgacaccgctcttcgatgccgcatacgcggcctgcccgatctgcccgtcgaacgccgcgaccgatgcggtgttgacgatcacgccgcgctcgccttccgcattggcgtcctgcttcgacatcgcttcggcggccagccggatcatgttgaacgtaccgaccagattgatcgacaccgcgcgcgcaaaacggtcgagcgaatgcggaccatcgcggcccaccaccttctcgcccggcgcgacgcccgcgcagttgacgagcgcgtcgatgcggccgaacgcgtcacgcgcggcggcgacggccgcctggccgtcggcttcgctcgtcacgtcggtcttcacgaagcgtgcagcctcgccgagcgcgtgcgcgaggcccgcaccggcctcttcgttgacgtccagcagcacggccttgccgccttccgcgaccaccatgcgcgccaccgcggcgccgaggcccgacccggcgcccgtgatcagaaaaacgcgatccttgatatccattcgcaatccgtacagtgtgtgttcagggttgagcgaccttgtcggcttccatcttgcgcaacacgaagcgctggatcttgccgctcggggtttgggcagcgcatcgacgaagtcgatcgcgcggggataagcgtgagcggacagccgccgcttcacgtgctggctcagttcctcggccagtgccggcgtgccgtcgaagtcgttcgacagcacgacgaacgccttgacgatctccgtgcgctccgcatcgggcacgccgatgaccgcggcctcgctcacggccggatgctcgatcagcgcgctttccacgtcgaacgggccgatccggtagccggacgacgtgatcacgtcgtccgcgcggccgatgaagctcacggtgccgtccggctcgagctcgacgttgtcgccggtccggtaatagccgcccgcgatcgccggcgtgtcctgctgccagtagccgtggaaccacagcagcggcgagcgcgcgatgtcgatcgcgaggttgccgggctcgccggggccgagttcgcggctcgcttcgtcgagcaccgcgacgcgatagccgggcatcgcgaagccggccgaaccggcgtggacggcatgcgcgaggccgtggtggttgttcacgaccatcccgagttcagtctggccgtagtgatcgtagatcggcgcgccgagcgccgcgtcgaaccagcgcacgacttccggattcagcggctcgcccgcgctgctgaccacgcgcagcttgcccttcagccgcgccgccgcttccgtcccggccgccatcagcatccggaacgcagtcggcgagccggcgaggctcgtgatcccgagccgttcgatcacgtcgtacgtgctgtcgaccgtgaagctgccctcgtagagcgtcgtcgcgtggccgagcatcagcgggcccgtgatcgcgtaatagagcccgtatgcccaacccggatcggcgatgttccagaaccggtcgcccgcacgcaggtcgaccgcttcgcgcatgtacgcgccgaacgcgagcagcgcgcgcagcggcaccggcacgcccttcggcaaacccgtcgtgcccgacgtcgacatcatcatgaacaggtcggaccccttgcgcagcaccggttcgaacgagtcggactgcgcatcgagcgccgcacggaaatcgatgtcgtttttcggcagcgtctcgcccggctcgcgcaccgtcgcaacggtcgggcaagcggcaatctcgtcgagcttcgcgcgattcgcgacgttggtcacgaccaggcgcgcgtcgctcatgcgcagccggtgctcgatcgccttcgggccgaacgcggtgaacaacggctggtagacggcgcccgcgcgccacgtgccgaggatcgtcgcgacgagttcgggcgtgcgcggcaacaggcccgccaccacgtcgcccggcttcacgccctgcgcgaccagcaggttcgcgacgcgtgccgacagcgccttcatctgcgcaaacgtgtagcggcggtgctggccgccggcgtcgatccagtcgagcgcgatcgcgtccgcggaggcgtgccggtcgcagcattccacgcacgcgttcaggccgcgctccaggtcgccgtgcaattgctgcgcggcggtctcgatactgaatcgggccacggcgtcggcgtaggccggcaccgcccgggcggtagctccatcaggcatgcgtgtctcctgtgcgttatggcccccggcgagccaggggcgcgacggggatagctcgatagtagacagccccacattgcaatcaatgacaaacggaatctagaatcgtgatcgcttttgccatgtcgggaggatgcaggaaaatggggccgcagatgatttcgccggatttcgtcgacgacgcgctcgcgtgcctgcgccggcaacgcatcgcgacggcgcccgtgctgcgcgccgccggcctgccggccgccgtgcgcgagcccgtcacgccgcagcaatacggcaggctgtggctcgcgatcgccggcgccctcgacgacgaattcttcgggctcgccgcgcgcccgatgcggcacggcagcttcacgctgctctgccacgcggtgctgcacgccggcacgctcgacaaggcgctgcggcgcgcgctgcagttcctgcgcgtggtgctggacgagccgcacggcgagctcgtcgtggccgacgggcaggcgcagatcgtgctgacgcagacgggcgcgccctacccggcgttcgcgtaccggacgttctggctgatcctcctgggcgtcgcatgctggctgatcggccggcgcatcccgctgcaacgcatcgacttcgcgtgcccgagccccgaccagcgcagcgactatcaccagttcttcggcgtgcccgtgcatttcgaccggcccgacagccggctcgcattcaacgccgcctacctcgcgctgccgacgatccgctccgagcaggcgctgaagaccttcctgcgcggcgcgcccggcaacctgctcgtgcgctaccggcacgatacgggctgggtcgcgaaaacgcgcgcgcagctgaagttgctgccggccgccgagtggcccgacttcgatacgctggccgtgcgcgtcggcacgacgcccgcgacgctgcggcggcgtctgcgcagcgaagggcaaagcttcgcggcaatcaaggacgagttgcgcggcgcgctcgcccagtcgctgctgcgcgggcacacgctcagcgtcgcggagatcgcagtcgagctcggcttcaccgagccgagcgcgtttcatcgcgcgttccggaaatggacgggcacgagccccggcgcgttccgtcgggacgtgcatgcggccgaggcggaaccgggaagtgcgagcggatgacgcggcaggcggtcgtcgacaggcgtgctgggccgacatggaaacgctcactcgacgctgatacgatgcgacctgccggctgccgttcgttgtcgatggttgtcgatggttgtcggcaagcgacggcgaatacacgactcaccactaccgctcccgctcctatgcaagccaccgacttttccgacactgaactggctgaactgcgcgcgcacggcatcgtgctgtttgccgaccgcgtgatcttcgacgctcagccgccgatgccggccgaccagatcgcggccgtgcaggcccgctgtcacggcgaccttccgcccgcactgctcgagctgtggcgaatgacggccggcggcagcgtcgactacgacctgacgctggagatgaacgcacacatcgaagccatcagctggggagctgttctacaacggcagcaacggctaccgcgacctggaaggctggatcgaccacgaactcgaactggccgaggaagccgccgacgagcattcacgcccgtggagcggcaggctcgacgtgttgccgttcggcggattcgagtactgcgaccgcatctacatcgtgacggaccccgatgcgaaggatcgcggccacgtgctcgcgtggaaacagggctgccgcccgcgtggcgcggcgcgatgcacgaggacggcctcgcgacggtcgcgccggacctgtacgcggcattcggcgccctgcagctcaatgcggacccgctggagcccggcggcgaaaacggcaccggcgcgacgttgctcgactatatcgacgagcgccaggccgagcatggcctgtcggcatcgctgggagacaaagtgatcgcgttctatcgccgggccgtgatcgactggcgcacaccgctcgccgacggcacgctcgccgcccaaccggcgctcgcgcgccacgcgttgcgacatgcgatcgaccacgacgacgcagcgctcaccgtgcaactggtaccgctcatcgcgaatctcggcgtggcactcgccggcagttcgaacccggccgactatgcgctgcggcgacagaaatttgctgccgcgagcgcattgctcgaatccggcgcaccggtcgcgccggattcgctggagtccgtgtccggcacggtgccgcccgcactgattcgcgcgctgctcgacgccggcgtgcagccggatgccgacgcgatggcgcgctgcgtcgccgtcggcggcaccgacagcgcgcgcctgatcggcgccgcactgtcggcccaaggcgtcgatgcggcgtctgcctgccgttcggcgatcgcgacgctgctgcacgaactcgagaccgacatcgcccgggtccgcgccggcaagctccaccaccatctcggcctcgacgggctcgaagcccacgccgagcgcctgcggacattcaggccgtgacgtgacgcccactcagcgggaaacgccgtcgacgcgcacggcgatatcccgcagcggccgcgagaacagcttgcagcctgcgtagtagacgagcgacgtcagcgacaagccgacgatccacgacacgtccgcaccgccgagccggctcgccagttcgccggtatagagatcggtcgccatgaacggcgcctgcgcgacgatgccgatgaaatacgagccgacggcgatcgtgttgaagcgtccgtagatgccgccgtcctgccggaagaacgaatcgacgtcgtactcgccgtgacagacgaggtagtagtcgacgaggttgatcgcggtccacggcacgagcacgtacagcagcagcaggatgaagttcgtgtagccggcgaggaaattgtcctgcccgaacaacgcgatcgcgagcgcaatcgcgcacaggacgatcgcggtgatcgcccgcgcacgcgccttgcccgaccacgacggaaagagcgtctgcagcaccgtgatggccgacagcgcgccgcaatacagctccatcgcattgctggccgcgatgccgaatgacagcacgacgatcacgagtacgctgatcccttgcgtgaggcccgtgaggccgctcacgacattgccgtcgggcgtcgcaaggcccaccaggcagccgagcagcatcgggaagaacgagccgagcacgcagccccagtaactcgaccagaacgccgtgcgcggcccggtatcgggcggcaggtagcgcgaatagtccgacacgtaaggcgcataagcgatctgccacagcgcggcgaccgacatcgcacccaggaagccggacaggttcagcgaatgcttcgagaaggtatcggcgggcaatccatgcacgaaaatgatccagacgaacgccagcacgagtacgctgcccgagcaccagctcagcagccgcgcatacgcgtggatcagcttgtagccatagatcgacccgagcaggctgatcaggccgatcgtcacgacgcccacatcgagcggaataccggcgtccaggctgtgcagcgcctgcccgccgaacacgcagttcgatgcgaagaagccgacgtacatcacgacgaccagcgcgaccaccagcagcgcgccgaacgatccgaactgcccgcgggtctggatcatctgcggcacgccaagctgcggcccctgcgcggaatgcagcgccatgaagaccgcgccgatcaggctgccgacgagcgtggcgagcgccgcccaccagaacggctgcttgaacaccgtggtcgcgagcgatccggtgacgatcgtcagcatcatgatgttcgatccgaaccagatcgtgaacaggtccttcgcgctgccgtggcgctcggtcagcggaatcggctggatggtgctttcctcgagatgagcaatggactcgccctgactcatttcgtctccttgtttatgttgtggtgttcgcgggttcggcggctggagggtggcccggaatgccaggtgcacgtgaagcgcgggttctgcgacaaactcattcttcttatttgcattcctgatcaataggcggtcgatagcgcatcgctttacatgactgccgcctgcggcactcaattctcaacgcgtcggccagccgctcctgtggatgcgcgaatccggcccgcctccggagcggaacccgtggttcggtgcgcttccgcccgtctgttgccggacggaagcgcgtcgctcggcggtcagcagtcgatgccgagcacttcccgcgcggtggcatccacggccttgcgcatcgtgtcgaccagttcatcgatttgcgcgtgatcgatcaccagcggcggcgcaacgatcaggcggccattcgtcgaacgcacgatcgcgccgagttcgaacccgaccgtccggctgtgccaggtcaggtccgcctcgttcgcaaagcgctcgcgcgtcgccttgttcttcgcgaactggatcgcgccgaccgcgcccgcgccctggatctcgccgacgagcggatggccgtcgaacgcatcgcgcagcgccttctgcagatacggccccgtgtcggtcttcgtccgttcgacgaggccttcgcgctcgagcacgtcgaggttggccagcgcgacggcggccgcgaccgggtgccccgaataggtcagcccgtgcgcatagacgccgcccttgtcgaccagcgcatcgcccacgcgccggctcatgatcagcccgcccatcggcacgtagcccgaggtcagccccttggccacgcagatcaggtcaggttcgaagccgaagtggcggtgcgcgaaccactcgccggtacggccgaagccgccgatcacttcgtccgcgcagagcagcacgtcgtattgacggcagatgcgctcgatctcctgccagtagccgtccggcggaaagatcatcccgcccgcccctggaacggctcagcgacgaacgcggcgacacggtccgcgccgatctcgagaatcttgcgctcgagcgacagcgccgcctgtttgccgaatgcctcggggctcaggtcgccgccattcgcataccagtacggttcgtccacgtgcgcgatgttcggaatcggcaggtcgcccatttcgtgcatgaatgccatgccgcccagcgacgcgctgcccaccgtcgacccgtgatagccgttcacgcggccgatcagcaccttcttcgcgggcttgcccatcacgtcccagaaccgccgcacagtgcgaatcagcacctcattcgattcggaacccgaattggtatacaccacgtgactgaagcgattgccgagcagcgcgaacagacgttccgacagttcgatcaccgaggggtgcgtggtgtgaaagaacatgttgtagtaggacagctccttcatctgccgcgcggcggcggcgatcagctccggccgaccatagccgacgttggtgcaccagagccccgacatgccgtccaggtagcggttgccgtcgttgtcccatagatggacaccttcgccgcgtaccatcacgcgcgcgccttcctcgttcagcgccttctggtcgacgaacgcatgcaggtgatgcgcggcgtcgctgcgttgatagtcctgcgtcgtacgatgcggaaagttgggcgcgttcatgggcgagtctccggttcgttgtgtggataaaggcgttgtcgtgttgcgcggcgcggccgcttgcggcccgccgcgtcgaatcagtaactgatccaggtcgtcttgaggcccgtgtacttgtcgatcgcatgcagcgaaagatcgcggccgaagccggactggcggaacccgccgaacggcgtctgcgcgctcaacgcatcgaccgtgttgacggacaccgtgccggcgcgcagccggcccgacacacggtgtgcgcgtgacaggctgccggtccagaccgacgcggcaaggccatagatcgagtcgttcgcgagccggatggcctcgtcctcggtgtcgaatgccatcaccgacaacaccggcccgaagatctcctcgcgcgcgatggcgtcgtcaggcttcacgtcgatgaagatcgtcggctcgatgaagtagcccttgccgtcgacgcgcggcgcgcctccgccgatcgcgagcgtcgcgctgtcgcggccgcgtgcgatccagtcgcgcacgcgccgatgctgcggctcgtcgacgatggcccccatgccgctcgccggatcgagcggatcgcccggcatgaacgcagcggcatgcgcaatcaggcggtcgacgaacgcatcgtgaatcgaacgctggaccagcagccgcgagttcgcggaacacacctcgccctggttgaagaagatgccgaagcaggccttgcgtgcggcaagatcgagatcgtccgtatcgtcgaagaccaggttcgggctcttgccgccgcactcgagccacacctgcttcatgttcgactgtgcggcgtactcgaggaatttcttgccgacggccgtcgagcccgtgaatgcgagcacgtcgacgtcgggatgcagcccgagcgcccgccctgcggtttcgccatagcccggcacgacgttcagcacacccggcggcaggccggcctcaagcgccagctcggcgagacgcaatgcggacaggggcgattgttccgccggcttcagcacgacgctgttgccggccgccagcgccggcgccactttccacgcgaccatgtcgagcggaaaattccacggcaccaccgcaccgacgacgcccagcggttcgcgcgtgacgaccgcgaggttgccgggatcggtcgacgcaacttcgccgtgcaacttgtcgacagcttcaccgtaccagctgaacagccctcctgcggccggcacgtcgatgctgaacgcgtccgccacgcgcttgcccatgttgagcgagtcgagcagtgcgagctccgaactgtgcgatgcgatgagctcgccgagccggcagagcacacgcttgcgctccgcgggtgcgcagcgcgaccagacgccggattcgaacgcgtgacgcgcggcacgcaccgcatcgtcgacgtccgcggtatcgcacgacgcaacttccgcgatgacggcctcggtagccggattgattgcggcaaacgtccggccgcttcgggccggcacgctgcggccaccgatatgcgcgagcgttctcggctcgacttgcgccgcgagacgtctccagtccgcgtgctgatggttttctgctgaagttgggttcattcaagactccgttttgacgaccaggcgtttgtgcgttgttctccgcctgaactcgacccgacgaaagacgccagcgggcgcagccgatgctcatgaccgccgtgaattgccgcagtcgtccggtcgacaaactgtcgatcatcaaaaagcgatttgaaagaacagtttttcttctcattgaagaggttatttctattcatcctgcgcgcgtgcagtgggttttcctgccacggcacgatcccggtgccgtttgtttgcgtgcgacctcatcggctttccggtgcgatgcaacgtgacacccgatgcgacgccgagccggcacgacattgcgccgcggccagtccgaccacatactggtcggacggtgcgaacaaggatgcattcgatggggaatgtcgatcagggtgccgcttcaatcttcggcgtcgtcggaacggccgtgtcgttgctggcggcaatcccgtacgcgctcgcgatctaccggcgcaccgttcgtccgcatctgttcacatggctcgtgtggtcggtcgtcacggcgatcgcggctgccggccagttcgtcgcgggtgccgggccgtccgcgtggtgcacggcggcgattgcggtgacatgctttctgacgctggtcgccagcgtgtttcgcggcgaacgcggctggacgcgcgtcgactggtttttcttggtcgcggccctgtcggccattccgctttggatgctgactgacgatccgacgatctcggtctgtctggtgacgctgatcgaacttgccggcctcggcccgaccgtccgcaagacgctccgcgatccgtggagcgagagcctcgcgtatttcgcgctgtgcgtgctcaagtacgcattggcactgccggcattgagcacgtggggtatcgcggtcgcgttctatccggctgtcaacatcgttgcgtcgatcggcatctgcgtggtgatgctggtccggcgtcaatcgttgtcggccacgcggtaagcggtatccgtcggtgcggtatgttgcctgctgtcgaggctcgtcgatatgagcgaaaccacaaaccttcagagacgatacgaggcccggaaatggatgcaatccgtacagtcatcgaacccagcgaagccgcgcttcgcgccgcgatgctggccaacgatgtcgaagcactcgaagcgttgctggacgacgacctggtgttcgccgttccgaccggccaggtcatctcgaaggaagacgacctggccgcgcatcgcgaaaatctgctgcgtctcgacaagctcgaggtgcaagaaacgcgcgcctgcgcgatcggcgagatgatcctgaccacaacgaaggcgacgctcgccggccatttcgacggcacggcattcgacggcgtgtttgcctatactcggctgtggcgtcgatcgggcgccagctggcgcatcgtcgccgggcatgcatcgcaggtcatgtagtcgcgtcgagctcgcctcccttcgagtcggcaagctgcgaatccggagttgtttgagtcgatgcgagccagacgatacctcgacgaaggtgtcgaccatgacaggagacgaaatgcacaaaccatttaccgtacgtgctgcccgtaccgcggacgcgggcgaactcacgcgtctggctcgcatttcgaaggcacactggggctatccgaaggactggctcgacttgtggcagggcgatctcacaattgcgccggaaacgatcgatgggtcgatcggttacgtcgcggaatccgcggaggcaatcatcgggttctgggtcagggcgtcgtcggaatcggatcgcccgacacctggatggctgttcgtccatcccgaccacatgggccggggtgtcgcccgtgcgctgtgggaagcggtccgcaaggaaagcgcttcgagagggatcaggagctttgtgatcgaagccgatcccaatgcggttccgttctatttgacgatcggggctgaaaaagtcggcgaaaaggaatcgagcgtcgtcccaggcaggttctttccaatcttgcggatcacgatctgactcgtgaggcagcaggaagcggtatgactcaccatgccgcactcgggagaatcgtgccggcggcggttgtggaagaggttccaaggggcatggagtgtaacgggagggcgtcgggagcgcagagctaccgacgcattctgcgcccggttgcagccaggccaccgatcccgatcactcgtgcatttccgtcgctggaaatgcaaaaccccgcctttcgggcggggtttctggcttaggagcctgacgattacctactttcacacgggaatccgcactatcatcggcgtagagtcgtttcacggtcctgttcgggatgggaaggggtgggaccgactcgctatggtcatcaggcaaagagggttgtcctgctggcgtggccaacagaaccaatcttggaagaagcagtaattaggttgtgtgtatcacacacgagaatccaacttgtcgctctggatcttgcggccggtgctttcacacggcgccgatctacaaggcagacttgttataggatcaagccttacgggcaattagtatcagttagctgaacgcattactgcgcttacacacctgacctatcaacgtcctggtctcgaacgacccttcaaggggatctagtccccagggatatctcatcttaaggcgagtttcccgcttagatgctttcagcggttatctcttccgaacatagctacccggcgatgccactggcgtgacaaccggtacaccagaggttcgtccactccggtcctctcgtactaggagcagccccttcaaatatccaacgcccacggcagatagggaccaaactgtctcacgacgttttaaacccagctcacgtacctctttaaatggcgaacagccatacccttgggaccggctacagccccaggatgagatgagccgacatcgaggtgccaaacaccgccgtcgatatgaactcttgggcggtatcagcctgttatccccagagtaccttttatccgttgagcgatggcccttccatacagaaccaccggatcactatgacctgctttcgcacctgctcgacttgtcggtctcgcagttaagcacgcttatgccattgcactatcagcacgatttccgaccgtacctagcgtaccttcgtactcctccgttacgctttgggaggagaccgccccagtcaaactgcctaccatgcactgtccccgacccggatcacgggccaaggttagaacctcaaacaaaccagggtggtatttcaaggacggctccaccgaaactagcgttccggtttcatagcctcccacctatcctacacagatcggttcaaagtccaatgcaaagctacagtaaaggttcatggggtctttccgtctagccgcgggtagattgcatcatcacaaacacttcaacttcgctgagtctcgggaggagacagtgtggccatcgttacgccattcgtgcaggtcggaacttacccgacaaggaatttcgctaccttaggaccgttatagttacggccgccgtttaccgggacttcaatcaagagcttgcaccccatcatttaatcttccggcaccgggcaggcgtcacaccctatacgtccactttcgtgtttgcagagtgctgtgtttttattaaacagtcgcagccaccagtttattgcaaccccttcaccctcctggcgcaggccagtcaagctacaagggcgtaccttatcccgaagttacggtaccaatttgccgagttccttctcccgagttctctcaagcgccttagaatactcatctcgcccacctgtgtcggtttgcggtacggtcatcgttagactgaagcttagaggcttttcttggaaccacttccaattgcttcgcttccgaagaagctcgcgccacacccttgaattacgcacccggatttgcctaagtgccttctccaatgcagcgaccgggacttccaacacccggacaaccttccgcgatccgtcccccatcgcatctaacaatggtgcaggaatattgacctgcttcccatcagctacgcatttctgcctcgccttaggggccgactcaccctacgccgatgaacgttgcgtaggaaaccttgggcttacggcgagggggctttcacccctttatcgctactcatgtcagcattcgcacttccgatacctccagcaccctttacaaggcaccttcgcaggcttacggaacgctctcctaccatgcgtgcaagcacgcatccgcagcttcggtatatagcttagccccgttacatcttccgcgcaggacgactcgatcagtgagctattacgctttctttaaagggtggctgcttctaagccaacctcctgactgttttagccttcccacttcgtttcccacttagctatatttggggaccttagctggcggtctgggttgtttcctcttgacaccggacgttagcacccgatgtctgtctcccgtgattgcactcttcggtattcggagtttgctatggcggggtaatctgcaatagacccccaaccatgacagtgctctaccccgaaggtgagacacgaggcactacctaaatagttttcggagagaaccagctatttccaggtttgtttagcctttcacccctatccacagctcatcccctaacttttcaacgttagtgggttcggacctccagtacgtgttaccgcaccttcatcctggccatggatagatcacctggtttcgggtctacgcccagcaactgaacgccctattcggactcgctttcgctacgcctgccctatacggttaagcttgctactgaacgtaagtcgctgacccattatacaaaggtacgccgtcaccccttacgaggctccgactgtttgtatgcatgcggtttcaggatctatttcactccctcccggggttcttttcgcctttccctcacggtactggttcactatcggtcgatcacgagtatttagccttggaggatggtcccccatcttcagacaggatttcacgtgtcccgccctacttgtcgcacacctagttctttcatactgttttcgcctacagggctatcacctgctatggccgcactttccagagcgttcggctaacaatacaaataaagagtgcaaggctcatcccatttcgctcgccactactttgggaatctcggttgatttcttttcctgcggttacttagatgtttcagttcaccgcgttcgcttcacatggcctatgtattcagccatggatactccaaaaggagtgggtttccccattcggacatctacggatcaaagctcgtttgccagctcccgtagcttttcgcaggctaccgcgtccttcatcgcctgtgatcgccaaggcatccaccacatgcacttgttcgcttgaccctataacgagtctgtctcatcgacagtcgctacaggttgagttctcgcgttgtgccgtattccaattgagtcaaacttagagttcgaatcatcttgagatacatcgatacaatcacaacccggatagttttcacgtccatctcaagacgcttccgctatccaaattacttacttcttccagattgttaaagaacgacagccgatactttcgtaccgctctgactggctcaatcgccaatgcaaaattctcggttcatcgtatgaaccaagcacttagcgttggtgattggtggaggcagacgggatcgaaccgacgacccctgcttgcaaagcaggtgctctcccagctgagctatgcccccattgagtacagataccctcaggtgttaccgccagacaatggtgggtctggttggattcgaaccaacgacccccgccttatcaagacggtgctctaaccgactgagctacagacccctgagtctgtctttaatttacagccgataagcgtgagcgctcaattttgcgagaagctctggaaaggaggtgatccagccgcaccttccgatacggctaccttgttacgacttcaccccagtcatgaatcctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctcccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccacctctcagcaggattccgaccatgtcaagggtaggtaaggtttttcgcgttgcatcgaattaatccacatcatccaccgcttgtgcgggtccccgtcaattcctttgagttttaatcttgcgaccgtactccccaggcggtcaacttcacgcgttagctacgttactaaggaaatgaatccccaacaactagttgacatcgtttagggcgtggactaccagggtatctaatcctgtttgctccccacgctttcgtgcatgagcgtcagtattggcccaggggctgccttcgccatcggtattcctccacatctctacgcatttcactgctacacgtggaattctaccccctctgccatactctagcctgccagtcaccaatgcagttcccaggttgagcccgggatttcacatcggtcttagcaaaccgcctgcgcacgctttacgcccagtaattccgattaacgcttgcaccctacgtattaccgcggctgctggcacgtagttagccggtgcttattcttccggtaccgtcatccccgactgtattagagccaaggatttctttccggacaaaagtgctttacaacccgaaggccttcttcacacacgcggcattgctggatcaggctttcgcccattgtccaaaattccccactgctgcctcccgtaggagtctgggccgtgtctcagtcccagtgtggctggtcgtcctctcagaccagctactgatcgtcgccttggtaggcctttaccccaccaactagctaatcagccatcggccaaccctatagcgcgaggcccgaaggtccccgctttcatccgtagatcgtatgcggtattaatccggctttcgccgggctatccccactacaggacatgttccgatgtattactcacccgttcgccactcgccaccaggtgcaagcacccgtgctgccgttcgacttgcatgtgtaaggcatgccgccagcgttcaatctgagccaggatcaaactcttcagtttaaacctgttactgttttcggttcggttaagaaccggtcgctcactcaaagctgacaggaatatgaatcacttcataaacctgacttactttagtgtgagactcttgatacttttgctatctgacccgaagatcagctcgcttccatcaagcgcccacacttatcggctgttaatttttaaagagcaatctgcgaggaacttcgtgtttcccggcagcgctgcgttttcagcagcagagaagcgagattatgaaccgtgtttcgcagctcgtcaacaactttttacactacatcgttgcgactgcggggctcaacttccaggccagccgcgcgcccgacactgcggcacaccaccagctttgcttccctcttccgcaccgcgtttccgttagcgcgaaagaggcgtgattctaagcacctgcccccatctgcgcaagccctttgtgaaaatattttgaaaagcccccatgcgctggcgcgcacggggctagcctcacgacgagccgcgcgtcgcaacgctatcaaacctctattggtgtgacgtatgcctctcgttccccttatatatgcggacgcggaacgggcaaggaatccggtgctgtcgagtatcatgccgcgaccgaaccacgcactcatatccacgatggacagcacgactcaacccggcgacgccgaccttcgcgacgaatatgcagcgctccgcgagcgcgccatcatcctggaagaacaggctccgccgcttctgcaacgcatctcggatgtattgccgcgaatcagcggcgaatccgaactggcagacgagcaccgcgagcggctcgtcggcgcgcgcaacgcggcgatggtctcgatcgaaaattatcagcaggcgattcccttcctgcagacggccgactcgatcatcgagcagctggacaagacgcccgagcgtgacgaagacatcgagtggcgcgaatcgctgctgcaacggctcgacgaactgatcgacgtcgcagtcgtgatgatcgacgacgccgaaggctacttcgaacaggcgcaagcctgcgacctgtccagcgtgccgaaagccatcctcgaggattgagtaacgcagcccgaaatcgcgtagcgcgccggcgtaacgccgtgtgcgccagccattccgatgcttgccggccggcaatcgcagcctgacaccttcgccggcacaccggccgcgcccctcccgaaaaagctcaccttttgctacgcgcctcgctagggccgcgcgacacaactacggtgcgtcgagagcgatcgtctcgttcacgatcggcacgcggatatatccgccctccgtatcgccatacgcgtgcgcattcccgtcgatgacgtattgcgcggtcaacgcgcacagggtcgcgtctcgcgcatcgacggacttcagcgtcgacacgtcgatccccagtcgctccagcaactgccggcgctggttgcgtttctgcttcgccgacgcaacagtcttgcccagcattgcgcaggtgatcgcataaggataggtttcgaagctcgcccgcccgcccgcatagcgcgcgccggtcagcagcggataggcgtccgcgagtgcgcggtagacgcgctctcccatgaacatccagtcgaagaaacctgacgtgctcgcgaccgcctgctcccgcgacggcgtcggaaagcatgagatccgttcgcgcgcgagcgcctgttcagccgcccggcgcccgctccccgtccaccacaggctcggtgcgtcgacaccgacggccacgacgtcatgagcaagacacagcgcaggcaccgcttcgggcgcgatccgttcctcgcggcaaacgaccattggtccgcgcaggatcacgagatcgcattgcttcttttcgccacccacatcgacacccgccacggccggcgattgccgcgcggatccagcggatcgggccgatcgcatgcgggcgcctcagttcgccggccgtgcgtcgtaggcggcgtcgaagatcgcttcgagaccgggatgcacgccgcgcatcgggtcgacgaccgacttcgcccagtcgaagtacgcctgcttgcgctcgagcggccagtccgcgggcggatgccgtgcgatgtcgcgcaggttgcagatcttgtcggcaagcttcacgagcttcgcacgccggctgatggtcgccgcatgctcgacctgcaggcgtttgcgctcttccttcggcaacgacttgtcgtcggtgacttccatcacgatgtccgccacgtccttgccgaacagccgcagcagctcctgctcggtcgtctccgtatcctcgaccgtatcgtgcagcacggccgcgacgatcacccgttcgtcctcgacgccggcctcgttggccagcacgtcggcgagcgcgatcggatgattgatgtacggcgacgcttcttcgtccttgcgccgctgattgcgatgcttgtccgccgcgaacgcgatggcggctaccagctttttcatattccccctcgtatggccagacccgcgaccggcagaaccggtcgcgcgcatttcagaaccgcacatactacctgcacgcgatgaccgcgcccgtgcgccggcatcccggcacacccgcatcacgcgctcaccggcgcgcgctgcagctcgaccacgttgacctgcgcaccgaatacgtccctcacgagcggcagcaggtggtcgtggtgcgtcaggaacagcacctgggttcgcgtcgacagatcgcgcagcgcatcgaggccggccttcgcgcgcgcgtcgtcgaagttgatgaacagatcgtcggccacgaacggcagcgcggtccggctgccgagctgcagttccagtgccgcgatccgcagcgcgagaaacaactggtcacgcgtgccttcgctcaacccggcaacctcgaccgacgcgcccttcgtccgccgtgcatacagggcgggcggcgtcctttcggtatcgacggtcagccgcgcgaattcgcccagcgtgagcccggcgaagatttcgcccgcacgcctgagcatcggcccctgcttctggtcgcgatagcgatccgtcgcccacttcagcaaccggctcgcggtagccgcttccaggtactgttcggctgcatcgcccatcgccgccagcgcttcctgccgtttcgactcggcaacggccgcgctcgcctggccgtcgatcgcgccgaacgcctgatcggccacgacctgctgctgtgaaagctcgttgagccgcttgccgacatcgctgagcgattgcttcaccgcttcgaggtgcgctggtacgtcggcgatgtcctgctccgcgacttcggcttcgacggcggagcgggacaggccgtcgccgtcgcgcaccaaggcctcgtgcgcggcatcgaccgcctgccgcagctggcgctgccggtccgagcgttcggccagcggcagcgcggcatcgatcgacacgacaccggccagttgcagcagcggctggatgcgtgcatcggcaccggccaccgcggcggcggcatccgcgaccttgccgtcggcctgccgcacggcctcgtcggcccgaccgatcgcacgcgcgatttccctggcagcggcgaggcgcatcgtcagccggcgcgcgacgtccggccagtcgccgctcgtcagccattccggcgcaagcgccgcggcaagccgccgtgcgcccgcctcgagcgcggccagttccgcgcggatcacggcgatccggttgcgcggtgcgtcggcatcggccagttcggcggtcacggcgttggcaagcgcgagcgcaccttccgccgcggccaacgtcgccgcgctcgtggaaagcttcgcgtcggccagcgcgtcgcgccattgcgcgtgccacgcgtcgtaggccgcctgcgcgtggccggcgcgcgattgcgccgtcgcgcatccgcgttcggcttcccgtgctcgctcctcgagactgtcctgctgcgcgagcgctttctcggccgactgtacgaaggcctcggcggtcgcgacgagcgccgccagaccgtccgactcgccgcctcgcgacacggtacgcagcgcagcgcgcaacgcggcttcggcaccggcccgcgcgacgcgaatcgtgtcgaattcgcgacgctggcgatcgagatcggcctgcgcggcgaacaccgtgtcgcgcttcgcaagccagtcgcccatcgccgccagcggcatcccgggcaccgcggccgtcgtcgcgagcgcggcccatgcgtcgcgatgcgctgcgagctcacgttcgcgctcgtccagcgcggcctgcctgcgcgtcacgcccgcacgcgcggattcgacctgctgacgcagcgactgcaacgtcgccgccgcctgcgtcgcacccaactgcgcgtcgacgagttcgtccgcaaggcgaattgcatcgtcgagcgcgggtgcgcccgttgcgagatcgatcgcgccgctgcggatatcgccccatgcgccgtcgcgccgcgcacgcgctgccagcacgtcagcggtcgtgacgaccttgtggttctccgcgaagtgcttctcctgcagttcgagccgctcgagctcttcgagcgcgccgtcccgtgcgtcgcgtgcagcagcggccgcgctcgcgcgttcgctgtcctccttcagcagcgcgccgagccgcgccaccgacggcacgtcgagcgcgcgcagcgtgtcgaccggcatgcgccaccggccgagcgcatcgagagcgccggacagtgtgcgttcggcggcagcgatttcctgttcgagcgcctgctcgcgctggccgctgttgcgaaagccctgcgcatcggccaacgccgcgcgcagcgtttccggcacatcgacggtcgacaggcgcgcctgttgttcctgcacctgtgcaagctcgcgcgtgcgttcgtcgagcgattcgcgcgcgccggacagcgcctggtgcagcgcgccgtgttcgcgcaacaggttggccacggtcttcagcgacagcgccgtcggcaacgacgcacgcagcgacgcttcgtccgtcggccagtcgagctgggcggccgcggcgaacgcggcggacaggtgccgctcgacgtccgcacccagcagcagcagatcctgcgcgtgattcatgcacgcgccgcgcagccgatcgagcgcttcgatgtcggcttcgagcgccagcgtgtcagcgtcggcgtcgatcgcatcgcgcgcctgtcgtttcgcgagcaggtcggcccgccgttcctcgagcaccttctgttcggccgcgagatcgccctgcgccttcaacagatccgcatacgcggtgggcggcaactcgacgaccgcgcccagttccgcgagcgccgcgtccttgaccgtcagctccttgaggtacggcgccagccgtcgcacgcgctcgagcttcgagcgcagcgcttcgagccggcgctgttccgcgcgcgcctgctcgatctgctgttcgaccgcttcgcgcgcgtccttgcgttcgacccagtcgcgcgtacgcacctgaaccgtcttcagttcggtcacggcttcgttgaacgacgtttcggcaagtgcaaacgcgctgccgctgcgacgcggcgcccacagctcgagcgcacgcgcatcgagctcctcgcgcaccggcccgaggctgccgaccccggcggccgattcgaacagcacctggccgagcttgtcggatgcgtcgagaatgctccggccgccgtcgaccagacgcccgtgatcgagcccgaacatctgctcgaagaattcgcgcgtggcgccgtcgagaacggcggccaggtaatcgtcgggcaatctgtcgtcggcgggcgtgcgcagcggactgcgcccgcgggcgcgatggaacgcgagttcgcccgtgccgctctccagcacgccgccgatccgcagttccggtgtgctgtgcaggaaatcgagcggcgtctgcagcttcatcccgaacagcagctccgacacggccgtgcggatcgtcgacttgccggcctcgttcggccccacgatcacatggaaatcctcgccggccgacggaaaacgcagcgtctcgtcggtgaacttgccgtacttgatcagatcgagctggttgatccgcatcgcttactcccctcgccagccgcgcaagcaacgcgggcccgacctgctcgacgagcgccgtgagctcgcccgcgcgcgccatcgccaacaacggcacctcttccttcacgtcgctgcgcaccttgccgacgaacggcttcaggtcgcgttcgagcagctcgaggaaatccggatcgcgcgcggcatcggccaggatctgcttcaggtcctcgagcgcttcgagctgctcgctttcgcccggctgatgatcggccgcggacgtcgcgagccggaccttctcgagccacagccgctcgttgccgatgatgccgatctggttcagcacctccgcgcgcaactgcggcgcgcggccgaaaaagaggccgtgggcaggcgtacgccccgcgaccgtcacgcgcaccgcgcgcggcacatggccgtcgacggtcagcagcgcttccagcgactggccgatctttctcgacaggtcggcgacggtcaggcaatcggacgcgtcgaccgacacggcttcccagcgcagcacgtcgagatacagacgctcgacctgcgtgcggccttgctcgaccgtcacgagcaccgcgccgcggcggcccgtctcgcggatatggcgccctgcaggttgccgggaaacaccacggtggacggccccgaccattgctggaattcgtgcacgtggccgagcggccagtagtcgtagcctttcgcatggagttcggccagcgtgcacggcgcatagttcgcgtgcgccgcatagccttcgagcgccgtatgcagcacgccgatgttgtagtaaccgggcaccgggtccggatagccgatcgcgagattgtcgacgacggccttgtccttgaagctctgcccgtgcagcgcgacttcgaattcaggcagcctgtgggtttccgccttgcggtggccgaatacggtgacgttgtcgggcagcgtcagcttcttcgtcatctcgctttcggcatcgtggttgccgccgagaacgaacgcacggatgccggccttgcgcaggcgccccatctgctggccaaagaagatgcccgtgttgtgatccttccagtcgccgtcgtacaggtcgccggcgatcacgaggaatgcaacatcctcttcgatcgcacgatccacgagttgccgcaacgcctcgcgcgacgcgttgcgcaactgcgcggccggcgcgtcgggatacgcgctcaggccgtgcaacgggctgtcaaggtgtatgtctgccgcgtggatgaacttcacgaagattcctctgtttcatgacgataaaaccggcgatcgccgcgcgatgccgtgagccaggccatcagtcgcaatcctggtagccgccgggttcgccgcaacggatacagcggaacatatacgcggtcggtgaaccgtccttgtcgagtgcggcaaggaaatgctcccactccgcgccctcgtcgagtccggtcgattcccgaatcgacgcgactgcctgcgggccgagcgcgcgcagttctccggcacccgcacgaccgacgaactgcgcggcatcgccgcaatgcgtccaccaccgctcctgctgccaaccctgaaagcccggcgtgcgacaagcgatttcgctgacgaccgcgtcgggcacttcgtcccattcgccgccgccgatgccgtccgtgccagtgaaggctgcgccgaaccatcggcgatgcaccatgggcagaggcaattctcatactcgtcgaccgcatgcacggggccggcgtatacgtaaccacgtgcatcgccgcaacacacgcagcgcgcgtccgagcggatcacgctgcccgttgccggcgggtcgggatggtacctgaaagcgggtaacgacatgacgctctccgtggatccggaaggaagggaagcacgcgatgcgatttcgaatcgccatcgtgccacgggatgaccgtgttaccgcggtacctcggcctcgacaaacgtgccgttcacgaaacgataaacgcgatgcagtgcgccgccatgcgcgacatattcccaccggatgtcgatggcggccggatcgtcgtgccacgcgatcgccaggtaaggcgattgagttccaccgtcggtttcgagagaaacggaatcgagacagctttggaccggcagcgagaaacgtggcaccgcacgggtgccgcgcagttccagcacgtatagcgacccttcttcgcccgcgccgcaatatccggtcggacggctgctcgaagagcgattgacgacgaccagcagatagtcgttgccgtcgatccgcttcaaacggcccgacggaaacgcaacgctcgatgcctccgccaacgcacggcgcagcgcggccggcacgatcagtgccgatttcgtgtggcgggccgcatcgacctcgaacaacctcgggctcgcccattcgatctcgtgaccgttggcgagccgcaccgattctggcgccggcgtttcggcgaatccaacggcggcattcgaggccagcagcgccagcgccgcgagcttcaatgcaatcgacgatctcatcgggccgatccatgctcgcaagaatcgcgcaggaccgtcgcgaggtccgtcgcatgcgccggcatgccgctcgggccgcggcgacccaggatcgccgcgcgtgcatcgttcgccgcgacgcgcgcggccgatccacgacgcaacgtcactctccgcgcggcaccggcggcggagcatagccgttgtcattgccggggaacggattcgcgttgcggcgcagcgcttcctcttcattctccttctgcgcgaacagcgcgacgccgatcacgccgacgttcgccgaatcgccgtacttcgagttcgcgacgtagctgtcgggcaccgccgcgaagcggaacgcggcgacttcgtcgcggctcttgcggaagccctcgatcgtcagcgtacggcccggatacagcacgtaaccgccattcgtgtagctgcccggccgccccgacagcacgtcgagcccgtcgacggtcgacacgacttcgaacgtgcggcgcccctggttgcgcagcacgatcatgtagcgcgaaccttcgacgcccgccatgtgccagcggccattgctgcgcgcgagacgcagcggtgcacccttttcgtccgtaaacgacagcgcgatgtcgccgttggcgagcgcgacgcgggtcggcaaccggcgaacctgggacgcgggcggatgtccgggcagcgcatcgttgtaatagaccgacgcgagatccgtcggcttcgccggatccgcgcgttcgaaatcgacctggcgagtttcggatcgcaccgactcgccccatgcagtgccgagcccacggcgttcgctggcatccggtgcggcggcggacgcgccggtgctggaggacggcggaggcggcgctgcgcaggcggccagccagagcacgcaggcgagcgcgagaagacggaacaggatggtcatgacgtgaggcctcggaatgttatggggccgcgccggactggccggaacggcattttggtgtcgtctgtcgtcacgatgtcgatcggacatgctggcccgtgtcggccggcaccgcgatcccggcggcccggcgaccgggagccccgctatttaagcatggcgggcgggcaatgggcagggcgcgcacgccgcccgttgcgggcacgtgccggcggccccaggcaaaggcgcgcatacgtgtcgcgtcgccggaccggtggcgaacgtcgacgcatccccgtatcggggatgcgttgaacggcgcgccgagcgcgccaataaagcccggcccgcatcgaagcgggccgggccttgacgggaagcgtgacgcttacagcgcgccgccttgcgcggacgccgaacccttcacaccgaccgatgcgccgccttgcaccgcgttcgtcgcaccttcgagcgcctcaccggccttcgccttcgcgccgccggcaacgtcgcctgccgtcgacaccgcgccttgcgcgtggctcttcgccttgcccgcgacatgcttcacgtgcgctttcgtcgagtggacggccgatgcggcggcatccttcgccgtgcccgctgccgaaccgaccgcatgcgtcgcaccgcccaccgcgttgccggccgccgatcccacgtcaccgaccgtcttgccgacgccgttcagcgcaccgccgacgacgttgcccgcgcccgaacccgagcctgccgcgttcgcgccggcgccggcctgcacacccacgccaccgccgagcagcggcgtctgaacctgcgcgccgacacccgcggaaccctgggcgccggtttgcgccgtctgtgcgaacgcagccgaagtcgccactgccgtcagtgcagcacccaccagaatcgtacggatcttgttcatggtcattctccccaaagacgttgttgctgcgggccgccttcgtgcggcttgtcgcatgcctcgccgcgacgtgcggcaggtggagctaatgtagcggcgcgaacgcgcaaaacgattgatttgcggggactgttacttcggttgcaaatgctgacgattgattcacacagtttgacaatcggaggattcaacgggatcgggacggcgtagtccgacggacggggagagtctggaggcgtgtcgcgcggtgcattccgcgacagagacaaggccgatcgccgcggatcggaaccagacaggcgaaacggccggaagcgaccagaaacagctagcagggaaaccggccgcttctataagcattccaaaggacgctcgtcggccagccgtcggtacggcctgacaaccggcttctcgcgatcagctcgatgtcgtcggacacgcacgccgccacgccggcatgccccgatgcgccgaatgcgagcttgaacgccttttcctcagcgcatccacggccggccggtcgagcgctgcgcccggatcgccgtcgatttcgtcgaacgacgccatccactgtgcatcgaacggctcggcatcgcgactgtccagcgcgcggtcgcaatccaggtcggcgaggaaatcgaaaagcccggcgccgacaggatggcgtccatttcaagcagatgcgcatgcatcattgcggctccttcacgaggcacggccccgatcgcccgtcggccaatacgggcagatcggaaccgcacgcgtaccgcccgattatggccggaacgtattgccgagcacgacgccttcacgccgcggatcggtgccgccctgcaacgcgggcgactggccgaccgtcacgcgcatcaccgtgttgacgccgctcgcctgcgcggacgtcgacaccttgtgcccgagcgcgagcagccccgtgatcagcggatcgttcgccccgttgttcgccgtgttgacgttcggatgctcgccgccgatcgtggtcgtcgggctgttgcttgcgccgaagtcgacgagcccggcggactgctgcgcatcgagaccccagtcgagcgcgccgacgagcgtcttgaccacgtattgcggaatcgtgccgccgcccggcgaaccggtcgccatcacgaagtcaccgcgcgagccgtccgcggcctgaccgaacacgatcgtcggcgccatcgagctgcgcggccgcttgcccggctgcaggcggttggccaccggattgcccgaactatcgaccgggttcgcggaaaaatcggtcaactggttgttcagcaggaagccgttggtcatgtggaacgagcccatgctcgactcgaccgtggtcgtcgcgctcagcacgttgccgtcgccgtcgacgatcgtgaactggttcgtgccgtgctcgatcaacgtcgtgtcgaccccgagcggtaccgcaccgagatcgcccggctgcgcgatacccatgctcttggccgggtcgatcagcgccgcgcgcgatttcaggtaaggcttgttcagcagcgtattccacgtgccgcccggcagcggcacgaaatccgtgtcggccacgtatttgtcgcggtcggcatacgcgagccgctcggcctcggtgatgaggtgcacgcccgcgacggtcggcttgccgccttcgagatcgatcgccgtcggcttcagcgacttcaggtcgtagttctcgagaatgccgagtgccgacgcgaccgcgatgccgcccgacgacggcggcggcatcccgcacacccagtagctgcgataggtcgtgcacaccgggtcgcggcgcttcgcctggtaggcggccagatccgcgacggtcgtcttgcccggcgtgagcgtcgagccatcggcgcccttcgtcgtggcgatcttcgcgacgatgtcctgcgcgatctgccccgtgtacagcgcgttcgcacccgactgcgccatcagcgtcagcgtgcgcgcatacgccggattcttcagcacggtgccgagtgtcttcggcgaaccgtcggcgttcaggaaatacgcggcggcctcggggtcgcgcttcaggttcgcggcgttcgccgcgatcgcgtcggcgagccggccaccgatcgggaaaccgttggtcgcgagcgtgatcgcatcgccgaacaggttctgccacggtagccggccgtgatcctgctgcagcgcctcgatgagcctcggcacaccgatcgtgccgatcgagcggccgctcgcacgcgcattcggcagcggcgcggagtggtcggtcgcatcgtcgacatagcgcaggtagttctccgtcgcggcggccggcgcggtttcccggccgtcatacgcctgcagcgtcttgccgcgcgcatcgtagtagagcagcacaccgcccgagccgaggcccgtcgcttcgggcacggtcagcccgagcacggcctgcacggcaaccgccgcgtcggcggccgtgccgcctttcttcagcaccgcgcaaccggccgcgctcgcgtaggcgttcgacgtggcgaccagatacgtttttgcatagacgggcttcatcccggtgcgataaccggacgacgcttccggcagtgacgggtcgcccggctggttcgacccgaccacgacagtcgagccgctgttgtcgattgcgagacaactcgtgtcggccgtgggtgttgtcgtggcgcccgtgtcggtttcgatgtcgttgccgccgcaggccgtcatcatggcggccgcgagcaacgcggacgcatacggaaagatcgctgttctgttcattgtctgccgatgttcttgtcagtcgttgcgagggacaccacgctgcctgcgacccctcggtgcgccgacaacgcattcgatagtcccatgaacaaattttttccgcaataagggaatgaagtaatgcagccggacgttgcacgcacaacgtcacgaccgcacgcgcacgggtacgtgttgcactgcatcgcagcgcgatgcgctcgcgtggccgctgtcgttatcgcgctgcccggcggcgcttgccggccgttcggccgtcgcgcgcgaaaccgtcttccatcgcttcgatcgcgtcggagaagaactcgaggaacatcgtcatggcgacagtcgcgctcatgtccgcccgttggtagatgcagctgaacgagcgcgcgcccgcatcggcaagcggcgtccacgcgagccggccggcagccacgtcgtccgcgacgttctcggcgatcaggaagccgacgcccgcgccttcggccgcaaggcgccgcaccatcggcaccgaacccgtctcgaccagcggccgcacgttgcgcggctgtcgtgcatcgatctggtcgaacatcgcgcgcagttccgtgtcgggtgtcatcaggatcagcggatgcgcgaagcagtcgcgcatccgcacctttccgcctgacgccgcgagcggatggccgggcgccgtgacgacacccagcggctgggcgaacgcccgcacctcgacgacgcccgccgacgtgcgccggcgcaacgcatagccgatgtcggcctcgcccgtctcgacccagcgcacgatgctttcgccgtttcccgagcgcacgctgtacgtgacgcccggatagcgctgcatcgcggcaaggatcgcgtcgggcacgagcttttccgcggtcgacgcgggcaccgccaggttcacgtggccgcgccgcagcgcgcgcaggtcctcgacctgcgtgagcgcgttgtcgaagtcgcgctgaccgcgccgcacggccgcgatcacgatctcgccggcaagcgtcagctgcatgccgcgcggcagccggtcgaacagcggcacgccgacctgctcctcgagattgcggatctgctggtgcaccgccgcggcggtcaggtgcagcgcgtcggccgccttgcgaatcgagccgcgtcgcgcgacttcgtcgaaacagcgaaatgcctgcgatatcgaacgcatgagtgatccgttagttttttccgaacaggccgtcaagaataatccgattttactgatcgcccggatcgtctagattgcgctgcatccccgtgtccgattcgaatggagagtgcagtgacaaccgtcgaccagattacccagcgccgccgtggcgtcggcctcatcgcccacgatcccgcactgtccgcgggcggctatacgctcatcgcgccgcagacggccgacggcaacgtctatctcgtcggcatcgacggtgaagtcgcgcatcagtggaagatgcccgtacgccccggccgccatgcggtcatcctcgcgaacggcaacctcggctacaacggcaatcatccgcactccgaatcgcgctatgcgccgtggtcgatgtggcatggcggcgacttctacgaagtcacgccgcaaggcgaaaccgtgtggcgctacgaggaccccgcgcatcatcacgacgcgcagtggctgccgaacggcaacctgctgtacgccgcgtgcgaaccggtcgacgccgcgttcgcgcggcgcgtgccgggcggcacgccgcacggcgacgacgaagtgatgtatgcggacgtgatccgcgaagtgaaccgggccgggcagatcgtgtgggaatggcgtgcgcgcgaacacctgcgacccgaggatttcccgatcgcggccggcttcgggcgctatcactggccgctcgtcaacggcctcgcggtcgacgcgaacggccgcgtgctgatgagcctgcgcacgacgtcgggcatcatcggcgtgaaccgcgaaaccggccgcgtcgacctgcggatcgggcccgacgtcgtgtcgcaccagcatgcgccggtgccgctcgcaaacggcaacatcctcgcgttcgacaacggcaatttccgccacggcgcgcacgtcgtgttctcgcgcgtcgtcgagatcgatccggcgacgcagcgcgtcgtgtggtcgtatgcggacgacgtcgtgaacctgttctacacgccgttcatgggcaacgcgcagcgcttgccgaacggcaacacgcacgtcaccgaatcgtcgacaggccgcctgttcgaagtgacgcccgccggcgaggttgtctgggaatacgtgattccgtggttcgccgaatacccggacgaagccgcgcgcaagaccgggccgggccagctcaacagcgtgttccagacgttccgctacagcgccgcgcaactgccctggctgcgggcctgaccttgccgttcaccgccggtttccggcgctcgtcgccgttcgcttccgaggggcctgccgtgtcgcacgatccgatcccaacgcccgtcgacgcacggctgcccgcctggcagctcgcgctgttcgggctgcagcacgtgctgtcgatggccgcgtccccgatcacggccgtgttcctgatcgcaaaagtgctcgcgctgccggcggacctgaccgtccagctgatcggcgcgacgttcttcgcctgcgggatcggcacgctgctgcaatcgctcggcgccggcccgatcggcgcgcgcatgccgttcgtgatggtgcccggcggcgcaccgacgatgctgttcgccggcattgccgcgcaatcgggcctgccgaccgccgccggcgcggcgctgctcgccagcgcgttctactgcgctgctgcccgtcttcacgcgttgcctgcggctctttccgcgcatcgtcgtcggcgcgatgctgctgctcgtgtcgatcaacctgatccggatctacgcgacgatcgtcgtcggccagcccggttcggccgacttcgcccagccgcgcgcgctcggtctcgcgctggcgacgatcgtcgccacggtcgtcgtcgcgggtgcgttccgcggcacgctcgggcgcctcgcggtgctgatcggactgatagccggcgcaacgctcggctgggcgctcgatgcgatgccggcgctcgccgacgtgtggcacggcccgctgttcacgcatccggtatggctgccgttcgggatgccgcgcttcgacgtgctggccgcgctgccgctgctgatcttcaccgcgatctcgatggccgaggccaccgcgcagacggtcgccgtcggcgaaacgtgcggcaagccaatctcgctgtcgcgcgacgtgccgaagacgatacgcggcgatgggctggcgtcgctcgccggcgcgctgttcggcacgccgctgatcgtgaccagcgccgagaatatcggcgtcgtgcagacgaccggcgtgcgctcgcgctacgtgacggccgcggccggcgcgatcctgatcgtcatcgcgctgttcgcgccgctcgcgcggctcgcgtatgcgattccggccgcggtggtcggcggcaccgcgctggtcgtgttcgcgatgatcggcgtgatgggcatccggctgctcgccggcgtcgacctgcacgcgcgcgccaaccagtacacgctcgcggccgcactcgtcgtcggccttgcaccgatcctggtgccgaacctgtatcgccatttcagctcagccgtgcggatcgtgctcggcaacggcatggcggccgggaccctcgcggccatcgcgacgcaactggcgttcgccgcatttgcgcggctcagcggacaggcaagcgcgacagaggttgcggcttcttcgccttcgcgcgacggttgatggtggcggagggtgacgttgcgcggtgccgcgtgccggcgacatcgcacgccgagcagccggttcgtttgcgattggcggcccgacacccagcttcctcacacgacaggccgggctcatgtcggtcagccacggacgattcggatacggaccccgacgcgatgggactgggtgccggacgcactccgtttcttcaacacgctgctgctcgcttgcctggcccggcacaacgactgcatcgtcgacgcacgtcccgcgcactgacgcaccggttgcgtcggactggccatctgaccgattgccggagcctccgcgttccggctataaatcgtgcatggacacgaatcgctggacccacgaccccgtcggcgccttccgggcgtggcaggaaaccgccgcaaccggcgccgaccgccggccgttcgcgccgcgttcggtcgtgcagcacgtcgcgatgttcgaacggttcctgcgtcatctgatcgagcaccgcgtgtcgctggccacgttcgggcccgaccacgtcgcggctttcctggcggaactcgagcgcacctgtgcgcccggaacgtcgactcgcgtgcgctacgcgaagctgatcgaccggctgggccggcatctggtcgaggccggcgtgcgcacgattcatccggccggccggacgacgcgtgatctcgcatggccggacggcgagcccgagccgtgctacctgccgcccgatgccgacgcagcgctgcagcaccacgtgcagcctcgaccggacgacacgccggccgattgccggaatcgcgcgatcgtcgcgctgctgctcggaagcggcatcacttcggcagagatacgtgcaacgacgcacgacgcgctcgatctcgacgcgcggccgccggcactatccgtgccgcgcgatcgggcgcggccggcgcgccggatcacgctcgccgaattttcactggcgccgctcgccgcatggcgtgcgcgctcggccgacacgccggcatccgcgttgctgtttccgccccgcgcggcggtggcgcgatgaacgacatgttcctgctgctcgtggtgcgcgacgcgctgagcgcgatcggcttccacgcggccgacatgagcccgcgcgtgctgcgcaatacggttgcgcgccgccagttgcttgcgggtcatgcacatgccgacgtcagtacgatgctcggtctcgtcagtgcgcgaacggtcacgcgcctccggcagacgctgccacccgatgcggcagcggatcgcgccgcacacgagcgctgatcccgcgtccggcgcaggctccgggtcgtccggctccctattcacccggcttcgactggaccagccgcagaatccgggtgtcgtacggtgattgcatcacttcggcaatgcgggcctcggaagcagccggatgcagtggattcagcaggaagttgtgcgcgtgcggcacgacgacgctcggcacgcgcagcagcgcgctcggctgcgtgtgcagccactcggtaccggcgctgcgggtccagtcgacgttggatcgccagtcgtccggcgcgtcgccctccgcgatttcggcgatatcgaccgaatcggccacctcgatgcgaagcaactggtacccgctcggcaattgcgcgaccgtggcgatctcgaaatgaacgagcgtctcgagcagcgcgagcgccggatgctcggcgagatacacgacgggctgcccggcgaaatgccagcgcccgccggcgcgcaacccgccgatgcctttcaggtcggcgaaattgctgatccgccacagcgtcgtcaagcgaaataccctcgtcgatctgcgtgagggcttcctcgacgagccgcgcgccatgctcggtgctcgccatgtcgagcgacgtgcggccgccgaagcgctggagcccgttgcgcagccacgccatcgccttgtcctggtcgccgaacgtggccgtcgcctgcgcgacgatgcgcgcgagacggatcgccttgtcggattcctccggcgacaggcgttcgtgcgcctggcgacgatggctcagcgtgcggcgcggaatgatgaaggccagttcgtccgatttcagcccgcgctcggacagccggtcgatcaccgagacgtcgacgcgcgcgctcgccagctcggcaagatcggcccccgatcggactcggatcgccagcagttgttcgagaatcgtgaattcggcctgacgcggatgcgcgacgcccgaaggatgaaaagcaatggtgctcatgacttctcccggcaatttgcccaatcattataggcgttttgccaggaactggcggaaggtggatggagagtgtggctgtggtggagatcagggtgtccgcaaaggcgggggcaagcatgacccacctgcctggaggcgcgttactgggggcgaatcaaagattcgccagggtgatggaaggcacttgttcagtatataaagtcatggaaatatgacgtggttgtcacgtaacaacatctttactgatttcatccgctcccaattcgccgcccattcttcctgacaaggccgagaggttcgccaaggacacggagatttcgtcaagtgcggccccggtccccggcactgggaaccctgctcccggcaattcaccgttcgtcacgacggaaacacatcgccgcgcctcgcgccggatgcgtccccatatcgcacgttccccgtcgtcggtcatgaacacccagtacgagacctcgtcggccattcggcctccccttgcaggcatcgtcgaacagtgtcgagcacacaccgacaccggggctgtcggatatgtagtgaggtttgggcgccatcgaaacactcgtatgggtcgaaaatccggcagcgcaacgaatcacgcccccatacacggctacctttccgctggtgatgcagcgatgccgtgtcgccgtaccgcccggcttgcttcgacgacaccgcaagccgcacccatgtcgccgtaatgtccacgccatatgtcgatccggccttcgcacagttgccaactggtcgcggaggatgttctgcgaatccccgaagatccgacgcgtggtgctgtccaacaaagtcggccgcaccaagtacaccggtgaacgtcggaaaacgcgcaaccgcctgccgattaccgtgaaggttttcgcccttgtgtatcggctaagcacacgccgtaagcacgacatcattcgcatgcgtgcgccgctcctgaatcacttcgcgatcagccagacgtcctgcgacggcgcggggccgcgcgggccgaccgtctggatgttgacgttatcttcgaccggcgcgccgttcgctccgatcagctttcgatcgttcgactggtccaacatgatcgcattcctgaatatatgcgaatcgcgattcgcgtgacgtgcacgatctccgttcagcagcggaggtcgtgcgccataccgcgaacaatcagcccgcccacgcggacgaccggatcacgctgcagaagttgccggcgtggaaatgcggatccttgtcgccgagcacgtcggccttcacgttgccgaacgtcgtgtcgggcttgtgcctgatcccgtcgtagaacgcctggatgatgtcttccttgaagtgcggcgtacgcggatgcgcacggacgacggcctcgcgttcaacgtcgctgtattccggatatttcaggcccagcacatccatctcgacacccgcggtcacgagcgcgatcaccggatgcatgtgctgcgggatgcccggcgtggtatgcagtgcgatcgaagtccataccacatcgatatcctgctgcgagatgcccttgcccttcaggaaatcgcgggcggcgttggcgccgtccacctcgaaccgctcgcacgcgctgctgtgtttgtgcgtgagccccatgtcatggaacatgcagccgcagtagagcaactcgggatcgtatttcagaccgcgccgctggcccgcgagcgcagcgaaatagaagacgcggctggaatgatggaacagcaacggcgacgcggtatcgcgaacgagttcggtgatctcgcgcgtcagttggctatcgggaatggtgatgcctgcaacgttctcagtcatgatcgatctccattgaaaacacccttgattctccggatcccgatagctgtctccaatagacgcattacgtcaaatcctgccattttgcgcgacagacggacacggtgcccgcacagcaagaagaacgccggaaacaggctccgccgcgcgctccgtgcatcgccggccctctatactgctacccgtcacgttcgaaacaacacgcaatcgatcatgccgaaggtcgtgggaatcttcgccgttccgggcgttcaactgctcgacgtctccgcaccgctcgacgtcttcgcgcaagcgaacgccgaatacgggaaaccgttctatacgttgcggatcattgcgggcgagtccggcccgatccgcagttcgtccggcgcgcagctgctgcccgactggatcgttcccgacattcccgagcgcatcgacacgctgctggtcgccggcgcgccgggcgccggccggatcgcactgcgcaccgacgtgctcgcgtggctgcgagcggcggccgtgcagagcaagcgctacggctcgatctgcaccggcgcgttcatcctcgcggccaccggcctgctgaaagggcgtcacgtgaccacgcactgggctgccgcggacgcgcttgccgaagcctatccgtcgctcgccgtcgacgcggacgcactgtacgtgcgcgacggcaagctgcgcaccggcgccggcgtgacggccgggctcgatctcgcgctcgcgctggtcgaggaagatctcggccgcgagatcgcgcggcgcgtcgccgcgcaactggtcatgttcttcaagcgaccgggcgggcaactccagttcagccgcaagggcgaggcgcgcccgccgggcgttcggtactgcaggaggtccagcgctggatcgcggccaatccggaactcgagcactcggtggcggagatggcgaagcatgcaggcatgagcccgcgccacttcgctcggctgttccgcgcggaagtcggcatgacgcctgccgcatgggtcgaggcgacccggatttcggcagcccgccacctgctcgagaacggccacgacacgccgaaacaggtcgccgcgaaatgcggcttcgcgaacgtcgatacgctcaggcggtctttcacccggcacgtcggcatcacacctgccgaataccggaaacggcaggcagtcctggccgagtgacgcggcagtatgcacgcgatacgacacgaacgatgatgtcgtcagccccactcgaacacttcggaatacgattcattcatcgtggtccggccacttgccgatcgacgacatcgctccattgacggcctcgcccgtgtcccagagcaagcgccggacaggcccgcaatcgtcagacgaaatactcacccgttcagatcgtttacccagttgcaataattattcgctggaacgcgtatttccgaccggtaacgcgatcgctacgatgcaatcaaccgctgaacgcaacaagcgaagcgcgaaatcaatgaaaccggaggtcgtcatgaagtcgttcatctacgctgtcgtcgccgcaaccgccctgtccgcctcgtacggcgcattcgcacagtcgaatccgtcgggccaactgacgcgcgcccaggtgcgcgcggaactcgtccagctcgaacaggccggctacaagcccgaagtctccgatcagtattacccgcgcgctgcagaccgcacaggcccgcgtgacgaacgccgatgaagccggctacggcgcacaagccgccgctggtgtgcgtgccggccgcgcgatcgcggtcaagcaggacggccgcgactccgtgtatttcggccagtaagcgcccgtcacgcgccggcgtattccgacacgcgcggcacaccgcacaacaccccgctcccgttcaaacggggcggggtgttgcttttcagtcatccgttccgggaacgaatcgcccctcatcgcacgcggtcttgcgaacgccgtgccgttcacgcaggcagcctgtgtttgcgcatagaatggccgcgtggtcggcgccggccgaaacgaacgcgagcggaaaccacgacgcccggcttgcccgatcgtcgccgcgccgcaggccggccccgatgccgcactcatcgcatttttcgaaaaggagcggtttcatgtctcaaacatccggttccatgatcacgtttcgacgcccggacggccaggaactgcagggctatctcgccacgccggcaaaaaccgaaggcgcgcccgcggtcgtcgtcatccaggaatggtggggctgaacgaccagatccgcggcgtcgcggatcgcctcgcgcgctgcggctacttcgcgctcgtgcccgacctgtatcgcggcaagtcgacggtcgaggaagaagaagcgcaccacctgatgaccgggctcgatttcggcgacgcggcctcgcaggacattccgggcgccgtgacctatctgaagacgcttgcgtcgcgtgtcgcggtaacgggttactgcatgggcggtgcactcacgctgctgtcgctgcagttcgccgatgcggacgcgggcgtcacgtggtacggtttcccgccgctcgactacctcgatccggcgaagctcaaggtgccgctgatgggccactggggcacgcaggatgcgttcttcgcgatcgaccaggtcgatgcgctcgagaagaagctgaccgacgcgaaggtcggtttcgaattccatcgctatttcgcgcatcatgcgttcgcgaacgaaacggccgtcggccccggccgtatcgccggcacgcagttcgatcccgtgtggtcgcaaatggcatgggatcgcacgctgacgttcttcggccgcacgctttggacaaagcaggcgtagcgcaacatcgcttcggatgtgagcagccgagcaataagaaaacgccacggattttcatccgtggcgttttcgcttttgcatctcgccggttcggcaggcagaagcagttgcccgctcctgccccgcctttcacttacccgttcgtcgccgccgacgacgcaggcgccggagcggccgccttgtcgtagttgaccggcgcatccggcgcgcgcggcgtctcgccggcccgctggatccacccgccgcccaatgcgcggtacagcgtgaccaggttcgtccagcgcgccagacgtgcgttgatcagcgtctgctgtgccgagtacagatccgtctgcgcggtcagcaccgacaggtagctgtcgacgccgttcttgtaacgcaggtccgacaggtcgaaacgtcgctgctgcgcgtgttcgttgcgctcgagcgccgcgatctgctggtcgtacgtgccgcgtgcggccaggccatccgccacttcgcggaatgccgactggatcgccttctcgtagttcgcgatctcgatgcgtttctgcacgttcgcgaggttcaggttcgcgatgttctgcccgccttcgaagatcggcatcgtgatctgcggcgcgaacgaccacgccgccgtgccggccttgaacaggccgcccagcgtcgggctgccggtgccgaacgcgcccgtcagcgagatgcgcggaagaacgccgcgcgtgccgcgccgatgttcgcgttcgcggccagcagcgtctgctcggcctgcatcacgtccggacgacgcgtcagcaggtccgacggcaacccggccggcacgtccgtcagcaggttctgcgcgtcgagcggcatgcctgccggcaggtcgtccggcagcggctcgccgataagttgcaccagcatgttcagtgcctgcgcacgcgcacgcgcctgcgcctgctggttcgacagcgcctgctcgaccaccgtctgcgcctgacgcagctcgagctcggagcccgtgccgttgtcgaactgcagcttggtcaggtcgtattgcgcctgagcagacttcagcgtgtcctccgtgaccttcagcaggtcatcggtcgacaacagcgtcaggtattgatcggccacctgcgacaccagcgagatctcgaatgcctgccgtgcatacgacgtcgacaggtactgcgcgagtgcctggtctttcagactctgcacgcggccgaacaggtcgagctcccacgacgcggacagcccgacgttgtagttgcgcgagatcagcggcgcattggtcgtcgacaagccctgcggaatgcgctggatgctgcccgtccccgtaccgtcgagcgtcgggaacagctccgcgcgcgtgatctggtactgcgcgcgcgccgcctcgatgttcagcaccgacacgcgcaggtcgcggttgtttttcagcgcgatctcgatcagccgctgcaggcgcggatcgacgaagaattcgcgccagccgatggcggtcgccgcctggccgttcgcgctgcgcgcgccggccgcacccggctgcgtcgcgtagacgccgccggccgggtacgcctgcgcgacgggcgcgtcgggccgcttgtaatgcggcgccatcgtgcaacccgtggcgaacagcgcggcagccatcgcgaccgcacttgcagtcaaagcatgtttttgcatcgttactgccccttcgaatcgtgtgcgtcgccgtgaccgcgctgcaggtcgccctgcacgagacgccaggcatcgtcgacgttttccgtctcgccgctgaagatcgcgcgaacccgcacgaagaacatcgggatcgtgaaaatcgcgaggaacgtcgccgtgatcatcccgccgatcacgcccgtgccgatcgcatgctggctcgccgagcccgcgccgttgctgatcgctaggggcagcacgccgagcatgaatgcgagcgacgtcatcaggatcggacgcagccgcaagcgtgccgcctcgatcgccgcgcgcaccggccccatgttctcgttcgcctgcaactcgcgcgcgaactccacgatcaggatcgcgttcttcgcggacaggcccacggtagtcagcaggccgacctggaagaacacgtcgttctcgaggccgcgcagcatcgtcgcgagcagcgcgccgaccacgccgagcggcaccaccatgatcaccgagaacgggatcgaccagctttcatacagtgccgccagacacaggaacacgacaaggatcgagatcgcgtacaggatcggcgcctgcgagccggactggatttcctggaacgacaggcccgtccacgagtagccgataccttccggcagcttgctcgcgagcgcttccatcgcggccatcgcctggccggtcgacttgccctccgcagcctgcccctggatctcgatcgacgatacgccgttgtagcgttcgagcttcggcgacccgtagctccagtggccggtcgcgaacgagctgaacggcaccatgccaccggcgctgttgcgcacgtaccagatgttcatgtcttccggggtcatccggaacggcgcgtccgcctgcacatacaccttcttgatccgtccatcggtatccaggaagttgttcacgtactgcgacgcccacgcgatcgagaacgtctggtcgatcgccgcagccgtcacgccgagcgcgttcgccttctcgcggtcgatgtcgaccgtgtactgcggcgtatcgttcaggccgttcgggcgcacgagcgccagcgtgggatccttcgcggccattccgagcaactggccgcgcgcggccatcagcgcctcgtggccgagaccggcgttgtccgtcagctcgaagtcgaagccggcagccgtaccgagttcgggaatcgacggcgggttgaacgggatcaccatcgcgtccttgtactgcgagtagtgcgcgaaggtccggccgatcagcgcctgcaccttctggtcggagcgctggcgatgctcgtacggtttcagcttcacgaacacgaggcccgcgttctggccgcggcccgcgaagctgaagccgttgaccgtgaacaccgagtcgaccacatccttctcggtcgtggtcaggtacgtgttgatgttgtcgagcgtcttgccggtcgtttcctgcgtggaaccggacggcgtctgcacgatcatgaacatgtagccctggtcttcatccggcaggaacgacttcggcaggcgcacgaacatcacgccgaccgcgatgaacaccgccaggtagatcacgagccagcgccccgaacgccggatcacgtggttcacgccgcccgtataacgatcgcggctgcggtcgaaggtacggttgaaccagccgaagaagcccttcttctcttcgtgatgcccttgcggaatcggcttgaggatcgtcgcgcacagtgccggcgtcaggatcaacgcgacgagcaccgacagcaccatcgccgacacgatcgtcagcgagaactggcgatagattgcgccgaccgaaccgcccgagaacgccaccggcacgaacaccgccgacagcacgagcgccacgccgacgagtgcgccggtgatctggcccatcgccttgcgggtcgcctccttcggtgacaggccctcctccgccatcacgcgctcgacgttctccaccaccacgatcgcatcgtcgaccagcaggccgatcgcgagcacgaggccgaacatcgacagcgtgttgatcgagaagccggcgaggcccatgatcgcgaaagtgccgagcagcacgaccggcaccgcgatcgtcgggatgatcgttgcccgcaggttctgcaggaacaggtacatcacgaggaacacgagcacgataccttcaagcagcgtcttgaccacttcctcgatcgacaggcgcacgaacggcgtcgtgtcgtacggatagtggacgacgaggccgtgcgggaagtacttcgacagctcctggaccttggcccgcagcgccgtcgcggtcgcgagcgcattcgcgcccgtcgcgagctggatgccgaggccggccgtcggctgccccatgtacttcgtgtcgaacgtgtagttttccgagccgagtgccgcgcggccgacgtccttcaggcggacctgcgaaccatcctggttgaccttcagcaggatgttgccgaactgctcgggcgtgcgcagcagcgtcgattcggtgatcgtcgcctgcagcatcgtgcccggcttcgccggcgtgccgccgatctggccgcccgcgatctgcacgttctgctgcgtgatcgccgccgacacgtcggtcggcgtgaggctgtagttggtcagcttgacgggatcgagccagatgcgcatcgagaactgcgaaccgagcagcagcgtctggccgacgccgttcacgcggctgagcggatcgagcacgtgcgacgccacatagttcgtcaggtcctccttcgacatgctgccgtcctcggagttgaacgcgaaccacatcagccagttgctgctcgacttcgtgacctgcatgccgagttgctgcacgacctgcggcaggttcggtgtcgcgagcgacagcttgttctgcacctgcacctgcgcgacgtccggattcgtgcccggcgagaaggtcagcgtgatcgtcgcgttgcccgagtcgtcactggtcgacgacatgtacaggaagttgtcgagaccgctcatctgctgctcgatcacctgcgtcaccgtgtcttccaccgtcttcgcggaagcgcccggatagttcgcctggatctggatcgtcggcggtgcgatcgtcggatactgcgcgatcggcatcttgaagatcgatgcgacgccggccagcatcagcacgatcgcgatcacccacgcgaagatcgggcgatcgataaaaacttggccatgaaacggactccttgttattgcgcggacgacgcagcggtcgaactcgcggcagcattggcggcggtgctcgccggcgcggcgccggacgcattcgcggcgcttgccggtgtgccggacgcggcgtccggcgccggtgcgagctgcgccgcgacggtcttcacggtcgccccgggcgcaccttgtcgacgccctgcacgatcacgtgatcacccgcttgcagaccaccttcgaccacccagttcgggccctgcatgcccgtcgtcttcagcggacgcggctcgaccttgttgctagcgttcaccaccatcgcgatcgcctgacccttctggtcatgcgtgacgccgatctgcggcaccaggaacgcgttctcgttcacaccttcctcgatccgtgcacgcacgaacatgcccggcagcagcaccttgcccgggttcgggaagaccgcgcggatcgtcaccgagccggtggtctggtcgaccgtcacgtccgagaactgcagcttgcccggctccgaataggtcttgccgtcttccaggatcagcgacaccttcgccgcgcccgggccggacgtcttcaggcgcccgctctgtacgtcctggcgcagcttcagcccttcgaggctcgactgcgtgaggtccacatacaccggatcgagctgctgcaccgtcgacatcagcgtcgcctggctcgcctgcacgtacgcgcccggcgtcacctgcgagatgccgacgcggccggtgatcggcgacacgacatcggtatagccgaggttgatctgcgcggtatcgaccgccgccttgccggccgcgacgtccgccgcggcctggccttgcgtggccaccgcgttgtcgtagtcctgcttgctgaccgcgttcgcggccaccagcaccttgtagcgtgcgaccagcgcgttctgcgtgacgaggttcgcctgcgccttcgcgagcgttgcctttgcactgttcagcgcggcgatgtaaggcgccgggtcgatcttgtagaggcgctgaccggccttgacgtcggtgccttcggtgaattcacggcgcagcacgatgccgtcgacccgcgcgcggacctgcgcgacgaggaacgcgctggtgcggcccggcaggtcggtgaagaccggtacggcttgcggctggacggtgacgacgccgacttccggcgtttgcggcggcggtgccgattctttttccgcacgcggccaggaaaacggcagccgttgcggcagtgattaagcggtatggaacccgttcgacgcgcatggagcgacctctcgcaaatagacgaccttcaattggaatcaccagatctcctcgtaacctgcacgcgcggccggaatgctgtcgcttcctgtttgccgcggatgcggttgcgtatgtcgggcgttcgttgcgccctgcggagcgttcgttcgtcgaactgcttccgtggaaaaagcgtcatgagcccgcggcactggcgggcgggcgttgccgcggcgaccaaccgggccgctaactcgcgggccggaacgcggtgccggcaaattcgatgaatgcccgtgcagcggccggcagacgcgcggtacgcgcatgcgcgagcttcagcgtgacgggcgcgagcgagtgaaccggtgcaacgcgcaccagcgcgccgtccgccagatcagcgtcgacgagatacgcgggcagcaccgcggcgcccatgccggccacggccagccgccgtgccatctcgagatggccgacgccctgactgccgccgggcgtcgcgtcgggtcggaacgcagacgcatcgtcgccaccggcggccggcagatcgagccgcacggcggcaagatcgggccagtcgcccgacgcagccgcgccgccgtgtgcggcgacataacccggtgccgcgacgcgcacggattcgtaagaggcaagcgtgtgcaacgcgtgcgcacctgtcaccggcatgccgtcggtcaggaacgcgacatcgacgtcttcggatgtcagatcgatacgggcgtcggtcagcgtcacggtcggccgcacgtccgggaaccggctcacgaaacgatcgagcaacgcgctcaactggctgagcccgaacgcgaccggcgcggcaatgcgcagcgcgccttccggcttgctgcccatcgcgacgaaacgaccgtcgatctcgtcgatcgccccgagaatccgttcgacgcgcgtgagatacaactcgccgatttccgtcagcgactggtggcaggtgctgcgttgaagcaggcgtgcaccaaggcgcgtctcgagcgcatcgaccagccggctcgccattgccgtcgacacgcgcagccgcgtcgccgcccggcgaaaaccgccttccttgccaccgtcacgaatgcccgaatcgattgaagttggtccatttgtccggattcccctgcgcggtcggccgcctggacgcgcacacctgctgccgcgtcccgaccgacatgtgacggcccggccaatgcggcggcaccgacgccggccacgccggatcggtcggcgcgctcgcgccggacgcgcaccggcatgcaacggacgcaagccggcctcggctggcccgatgcacgaatattcgaatagcagtcctgagtctcttgcagcgattcacagcggcaacgccggcggcatccgtcggcctggcgacgctcatacctgcgtcgcccgagcgcactggaacacgtttctttcagcaggtgcaatggtatgaaaaccgccggaaattggcttgcctgatcctgcgattgttttgccttaatttccgaatttgtgcgctgcacactgcgcaacgacgggcaatgcggccgccggccgtgcagatccggatgattgggctgatttccgacagatttaggcaatcacgtgcgcgcgactcgccgtacgatgtgaccgccacgccagccacctgccgagacaccgacggggaatcgcagtcgcgcaccttgcaccgccctcggtcatccgctcacgcaatatggaaatcgacgcccgaacgacgccgctacagcgcaccaaacccgatcacgaccctcagtcgcccacagcccggctcgctgcgctgatcgccgcctatgcaccgcacgacggcacgttcgagctcccggtgcgtggcttgcgcatcgcacgcgtgtccgcgtcgccgccacactggaaccatggcgtgcaccacgcgtgcctgagcatcgtcggacaaggcgcgaaatcgacacgggtcggcgacgccgcctacgtgatcgacgaatcgcggatgctggttacgactgccgacttgcctgccaccggccgcgtgacgcgcgcgagcctggccgagccgttcctttacgcacaactggaactcgacccggcccgcatcgcgacgctcacaccacgcgtgtttccgcgcgggctgccgaaggccgtcgactgcggcgcactcgacacgcacgatgcgccgcccgaaatcgtcgacgccgtcgtgcggctgatgcaactgatcgcacaccccgacgacatcgacctgctcgcgccgctgatcgtcgacgaaatcctcatccggctgctgcgcggcccgtcgggtgcgcgcgtcgcgcaggtcggccagagcgactcgacgacgcagcgcatctcgcgcgcggtcgcctggatccgcgaccactacctcgatccgatgacggtcgaatcgctcgcgcgacaggtggacatgagcccgtcgacgttccatcaccacttccgcgcggtcacgtcgatgagcccgttgcaatgccagaagatgctgcggttgcaggaggcgcgccgcctgatgtgcctgtcggcaatggatgcgcagcaggcgtgccgcagtgtcggctatgtgagcgcgtcgcagttcagccgcgaatacgcacgcctcttcggcgatgcgccgggccgcgatgtcgtgaagctgcgcgaccaggcggtgccgctatcccgcgtcgcgccgtaggccacgcacgtgacgtgcgtggcacccatgcaccgaaccaacgatgttcgatatcgaaagcaagcactttcataaaggcctgccagttgcccgcgcatccctggtctagccggtcgtgcagatgaattcgatacccggttcaaatacaggactgcatatcattggttcgattgacgcgcagcgtcatccccacacgccgacggcgcgacttcaggacgtgcaggaagcgttcagcgcagcctcgtcggtggacagcatttcgggtacgcattcacgcagaaaatcgacgaacgtgcggattttcgcatcgagatactggcgcgatgcgtacagcgtgtagacggtcagcttctgcaagcggtagtcgggcagcacgcgcaccagcgcgccgctcgccagcgcgggcagtgccgacgacatcggcaacgaaccgatgccgaggccggcgcgcaatgcggcgccgagcgcatcggcgatgttcacctggaaatccggcaacggcaggtcgaacgtctcggggccgtcggggccgtcgagatgccagcgatcgcgcggaaatacgggcgtgacgatctgcaggcacgcgtggccgtcgagctcgcgcaccgtacgcggcgtaccgcgctccttcagatacgcgggcgacgcgcacagcacgctgtgcacctcgccgagccgctgcgacacgagccccgaatcgggaagctccgtcgcactcaactgcagcgacacgtcgtagccttcgtcgatgatgtcgggcacatgctgcgacagcgtgagctcgaccgcgaccgacggataacgctgccggtaacgcacgaccgcgggcaccacgtaggcctggccgaagctcgtcgtcgcatgaacgtgcagccgcccggacggcttcgcctgtgcatcggccgcctcggcttccgcttcgtcgatatagccgaggatgcgctggcaacggtcgagataacgctgcccggcatcggtcagtgcgatgcggcgcgtgctgcggttgagcaggcgcgtgcgcagatgcgtctcaagctgcgcgaccgaccgcgatgcataggccgtcgtgatgtccaagcgctgggccgcgctcgtgaagctgccctcctccgcaacccggacgaaaatgcgcatcatctgtaacgtgtccatcgacctgtccccggattgagatcacgtcgcgccaccgtgcgcccatggtgccggcggttccggcgcgggccggtctggcgcgaattgtgcggaacagtacagcagcggtgcagacgtgtccagttcgccgtacgcggcatgatccggatgccgaatcgtgtcgccgagccgccatgcacgcgtcgtccggttcgtgtgcatgacgtccggacgcgccggcaagccaaccgcgccgaatcggcaaaactacccggcgaccacggtgtcgccgcacgattcacgtcatgtatgacggatcaggccgtggcggccacatcgaacggattgcgcaacacgatcgtgtcgtcgcgctccgcgccggtcgtgatcatcgataccggtgcgcccgcgaccgcttcgacgcgcgcgatgaaatcctgcgcggcgcgcggcaacgccgcgcgttcgcgtaccctttcacagtgccgcgccagccgtcgaaccgctcgtacacgggtttcgcacgcgactgcgcatcgaggcttgcaggcaaatgatcgacccgcacgccatcgagttcgtagccgacgcacagctcgatcgactcgaaaccgtcgagcacgtcgagcttggtgagcgccagcgaatcgatgcccgaaatcctgaccgcctgacgcaactgcgcggcatcgagccatccgcagcggcgcggccggccggtattcacgccgaactcctgcccgcgcgcgcagcgtttcgccagtcgcgtcggacagctcggtgaggaacgggccgccgccgacccgtgtcgcatacgccttggtgacgcccagcacgtggccgagcttcgacgcgccgagccccgtgccggccgccgccgccgatgcaacggttccggacgacgtcacgaacggatacgtgccccagtcgatgtccagcatcacggcttgagacccctcgaacaggatgcgctcgccacggtcggttgcgtcgttgagatcggcccagacggggcggacgaacggcaggattcgcggcgcgaggtcggcgagcgttgccagcatcgcatcgcgcgaatgctcgtcgagccccaggccgcggaaccacgcgttgtgatggtcgacgagcacatccagtttggcggcaagccggcccggttccgcgagatcgccgacgcgcagcccgcgacgcccgaccttgtcctcgtaggccggcccgatcccgcgcagcgtggtgccgatgggctcgcggcgcagacgctcctgagcctggtcgatcgcgcggtggatcggcagcaccagcgtcgcgttctcggcgatcgacaggttgtccggcgtcaccgacagcccgagttcggccatccgcgcgatttccgcgagcaaggcttccggatcgagcgccacgccgttgccgatcacgccgcgcttgccacgcacgatgccgctcggcaggagcgcgagcttgtatgtcttgccgccgacgaccagcgtatgacctgcgttgtggccgccgttgtagcgcgcgacgagatcggcctgtgccgccagccagtccacgacgcgtcccttaccttcgtcgccccattgggcgcccacgaccaccacgttcggcatgctccgcactccatgtgagaaattcagacaatcgttcggccgggccggccgtttgtgtgccatattggcggagcttgagcacccgatcaaacgattaaacctgaaccatcgcgtgagtaaatatcacgcgaaacgatgcaatggcccgacgcctccctccgttgaattcgctgcgcgcgttcgaagccgccgcgcgccacggcagcttcacgctggccgccgacgaactgtgcgtgacccacggcgcgatcagccggcacgttcagcaactggaggcgtggctcggacggccgctgttcgaacgccataaccggcgggtcgagctgaccgacgcgggccgcgcgtatctcgccgaggtcggcgcgtcgttcgaccggatcgcgctcgccaccgcgcagcatttcggccacgcgcagcagcgcgtgctgcgcgtcagtgcacctgctacgttttcgctgcgctggctggtgccgaagctgtcgtcgtttcaggtcgcccatccagccatcgaggtacggctgtcgacgtcgaacgagccgatcgacaagttgcgcgacaaggtcgacctgattgtgcgcggcggcccgcaggccatcgacggctacgttgccgaggaattcctgtcggaagtccggctaccggtatgtgcaccgaaactgctggaagggcgaccattgcatacgcccgccgatctcgccggcttcacgctgctgcacgcggccacttatcccggcatgtggcctgaatggctcgcggcagccggacatccgaatctcgtgccgcgccactcgctcacgctcgagcatttctacctgacgctccaaggcgcgctcgacgggctcggcgtcgcgatggggccgatcgcgctcgtcgcggacgacatcgccgaaggtcggctcgtgcagccgttccgcgaaccggcgctgccgccgtggcgttacttcacgtacgtcgcctccgcacgcgcgaacgacgacgccgtacgggcgttcaaggactggctgagggtgacgggaaatgcggctgcgccgggcgggcggaactgaccgtgtcggtgtacaaatggcacgcgccgtgaaatgcaggaatacgaatcaaataacgcaagcgactggattgcgtattgcctattgtcgatagcgggattgctgcgttcgatgtgcgccgtggaacggcgacgcatgcggcaagccgcggatcgatccgtggcttgccgccggacgacgcttactggcttgcgccgatgccggctttttctccgcgttctgcaggttctgcggatagttcggatcattggccgccggcttgtaaccggcatcttcgagtttcttcagctcggcgttgttcttcgcacgcgcagccttgtgctctgccttgcgctgggccctggccgccttgcgtgcctggctcttcgctgccttggcgtcctgtgcagcggacgcgctggcgtcggtctgcgcaaacgcgggaactgccgagccgaacaggaacgcggctgcggtagcagccaacgtgagttttctgatctggattcgcatcgctgaactctcttttctggtttatcacggattgaaagaccatcgagataccgcccctgccccggtcggttgtcatgccgcatccgggacctgtgcatcataaccgcgtcgtgaaaaatatggcgtcaacgtgcaacggagttcggggatacacgtatgggagaaaacgtggacggcactcgaccgggacggtcactgacaggacaggaattgtggatcgcgccattgcggaagccggacacccgcgatgtacctgcgccttgaagacgcggacgagtgatgtatggaggtgtgatgcgaaatacccatgactgtttcataggcggggttgccggcacgctcaccctggacgtgatcgtcattcggccaatcacgatcaccgcggtcgcagcagtcgaactgtgtgtcacgttgccggtcgacgtggctcaagcgacggttcctcccataaatgaccacgattcggtgttacggacatcaaggcaagcacgattgcatcgtacacagcgtgtgcagttcgatcaggcaacccatcgctgaactagaccccaggggctgccttagtgggcaaatacggtcgccgtgtggtccgtatgacgaaaggcgtggacgttgacagcggtgaagacatcggccgggaccgcttcacgattgattgcgctgacggcatcgcgcggatgtcaccacggtcgtcgggcgaatgtggtccgtggaaatgatgtcgccatgacgtgtgatccggccgattcagcgcaggaacgcatcggacggcgtgcccgaaacacagatttttattccgcgaccttagccgcagcgcatcgtggcgagcattgccgcccgcacagcatgccgatacctgcggcctcgtcaggccggtgggcttttacgagatccaaaagtgtcggaaggtgagaatgttcgggatcatcgctcgaattcgactgtggtgagcttcgtgatccctccatcttcacgttggcccgcgacgcatactggatcgacccagaacccggcgacacgtgcaaatgatgccgcccctacttgatctcagggaagccgttccagggtctctcgttgtgggcgggagggacagcattgattttcggttgatgaagccaaaggtagaaagttggacgcccccggccgcggcgaagcgagtcgcgtcgatttcctctgtgcacaaccgacaggctaggtttggccagaagcacaagccgacgatcggagaactttcttcacagacaaggaggcctgagtgcaaaaattccttcgccggccgtagcggatgatttcaaactgctgtgaacgaaaccgaagagatctatgtttccggtcgccgatcgactttgccggtcgatgacgttcattcgcgaggctgcggggatggtttttcgatcccataaacgggaacctgtacctggaaacgggcagtttccccgtttttctcccataagtttctacgtttcagccgatgtgagtatgtactcacctcttctggaagccttgttgggcctggaacctttgcggaaagaggagccaggccactgtttcccaggcctgaatcgaagctttgagatgcctgcaacaccatagacggctactcaatggtagcggtttatggggttcgtctttctgtggacgcgcacgtgtgtttacatctttgttaacgacgtttacttctttaactacttttagacggctcacagccttatcccacaagggtttgacaggtgttcggtacccatttatgggagcacaggtgtaagggtctggggtttcaggtctgtggatttggggtttggggtaccgggttgtggggagtccgggttgtggatatggggcaagcgtacccggttatgggaaatcggccaccgaacacgttgggtagtcgtctatgggaacgcatgtaggtagcctttatggggcatttttgatccctagacgcctgaatgcacagtgatttttcttgggtagccggttatggggcgcatcaaaggtacccggttatgggtggcatccggggctgcccgactgccttttccaggttttccagtggtcggttcccatggacaggatcgatggcacggacaggtaaccttttatggggaaaacagagggttgccgtttatgggagcggtatgtggcatccatgcaatcaagaccggttgaaaggtaccctcctgtgggaatcgatgaaggtagcaagttatgggaggaaaacgagactgtgctgcacggcaccatgaatgtgcccaacgatctcggttctgcacatctgtttcccatggatggttaccttggcgagggcaaatccgtgccgggtttccgtgaccgggtatgaaaggtagcagcttgtgggaagcattttgatcgaaaggtagatggatatggggtcccgcaaagatcgtctgatcgaagattttccttttggatctgaaggttagccgagatagtgcaagtaaagcaggaacaagggcgttgcccctcgccgcgaaaaggtataaagtccgctctcaacaaggtgaccttatccggacattacgatgccgcgcaagcccgcaagcaaaggctcagacaaacaggtttcgctgtttcagacacccgagcctcccgacttgctgcgcaaggcggtccaggcgattcatatcgcgcccaagtccgggaagatcgggctgcagcagcgcaagatgttcagctcgctgatcaagaacgcgcttcggcaggaggcgttcgagccgggccggacgagcttctcgatctcgatcgcgtcgctctcgcacgagagcgggttgaacagcaacaacacgaaatacgtgaaggacacggtcaactcgctgatcagtaccgtcgtcaactgggactatctggccgcggatcgatcgacagtctggaaagcgtcaggcctcctcgccggcgcggagctcgagcaatcggtgctgaagtacagcttctccgaccagattcgcagcgagttgctcaaccccgagatctacgcattgatcgatatgcggatcgctcgcgagttccggcggtctcactcgctcgcgttgtgggaaaacacggtgcgctacgaaggaatcggcatcaccgcgaagatcccgctgccgaaatttcgtgacctcattctcggccaggacaaggcgtcgcagtcgtacaaggaatacaagctgttcaagagcaaggtcctggtgccgtgcattcaggaggtgaacgaagtttcggatcacacgctcgagctgatcgaacacaagtccggccggagcgtggaagctgtccagttcaaggtgacgcgcaagcagagcgccgatacggtggaggacggcgacgtcaagaacgaagcgctggtcgaggaggtcgccaagttcggcattccgcgttcggaagcgcgccggctgatcacgcaatacggcgtgcagcgcatcaaggctgcgattgcctacacgctcaatcggactacgaagaagaatgcggcgccggtcgacaacgtggccgcgtacttccgcaaggcgttgacgcacggctatacgctggccgacgggcagggaacggaggcggccgcaccggcgaaggaatccgcgcagagcaagcaggaacagattcgcgacaaatatctggcggcgaaggtcgaggaagccggcgcgtatttccgcgaactggagatcgacgaccagaccaagctgatcgagcgttacaacgagacggtggcaggctcgaaggatttgacgctgtcgccgaagaagaaggcgagcaaactcgcgcagaccagtttcttccgatggctcgcgctggatacgtggggcgaaccgacctcggacgacttgctggaattcttgctgaaaagcagtctcgcaggcaactgaacgaggcctcgcagccgggtgcgcgtcgcgtgccggacgtcatcgtccggcttcgcgatgaaacacggatgcgaggccttctgcttttcgcgcgttacttttgcgtagccgttgccagctcggcaacgtacgcgtcgatgacggtcttcagcttgtcggcgagcgcctcctggtgcgatgcgtcgacgcccttgagctgcagatccaggcggccgtccggataggtcttcaactgaccgatcgcttgcgattcgagcgcgaagtcatgccggacgctgtaacgggtgcgtccggccttcttgctgccgtcgctctgcgtacgcaggaaattctcgagatcacgaaccgactttttccggtcgatcacggccgtcagcagccggtcggccgtcggctcgcccaggcgttcgaagatcagcttcaggaaatacgccgcctgcaggccgaccacgtcgttcgcgctcgccatccgttcaaggagtgtgttcgggagtgcgttgagcgacagcgtcttgctgatcgatgccttgtcctgccgatcttttccgccagcgtgttctggtcggaaaagaccttctcgtcgaggagacgcttccacgcgaccgcatcgtcgaagatcgtctggcgttcgtggtcgtggttcgcgcgatacgcgatcgtgtagagctgctcgggcgtgtgatcggtgcggaacgtggcgttgatggtttcgtcgccgttgatgctcgtcgcgcgaagccggcgttgcccgtcgatcacgacgagcttgccgggaaactccggcagccgcgtcaccttgatcggctcgatctgcccttcccgtttcagcgtcagggcgagctcgtgcaggctcgactccgagtagaacacgcgcggattgaacgggttcggaatgcaatccttgaccagcacctttgtggcgcgccaagatcggccgtaccagcgggtgctgccgcggccgggcgctggcgggcgccgattcgccgatggtgttcggtgcggacgccggttcgggcagccgcgtttcgagtgccgcattttcctgcgcgagcccgcgcagcaggccggctgcgagatgcaggttgccggtcggcttcttgtctttcgaggtgtccttagccatgggcggctccggtagcgcgcgttgacgcgatgtattgggccatttccgtgaccagcttttcgatttccgctcgggcttctttcaggcccttcaggtaccgattgtgatgatggatcgtggtgccgagtgcaaacgtctgacggtagacctcgcgttgcgcgatctggctgtcgagcagatgctccctatttcttctgctcttagaatttttaaaatttcttcacgcattttagtttttccattaacactattcagcattaatgcggaagacagatttgggttacggacggatcgcatcgattcgatcatgcggatcatcgcgacggtgctgtagagatcggcaggcgacggcgacagcggcacaaggcagaaatcggcaacttcgagtaccgatgcgattcgcggatcttcgaggttgccggggcagtcgacgacgatcacatcgaagttcgcgtcttgtttttgatttcaccgccaatgccgcggccggcaggggccagcgaaagcaccgtcatcggcagcgtgttctcgccgctcgttacccaccggacggacgtgccttgagggtcggcatcgatcagggcgaccttattgccgcctgcttcgaacgcagccgcgatattgacggagatggttgtcttcccagtcccacctttttgattactgacggcgatcttgaaagccattaaattcctccacggagttttgcgtaatatatgcagttattatctaaatgtccagaaaaagccgtcgatgcgatgtatgtcttagtgaccgattgggttgtcacgtgacaagtagccgaatggctaacgagtcagcgatgggcgatgatcgagtaaaaataaaatcgacgatcttgctcgaaatgcacgtacaaagatcgcgggaaagttcgacgagctttaacggtggtgacggattgacgccttggaggctggccgcttgatcttgcggagctctcggcaaaactcttagtgacttcggtaggtcggcttagagaatgtcgtcgggaagctcagttgtcacgtgacaagacgtagaaatttggcacttttcgatgcggtccgacaccgagaaatatttgggtagatcgcggttacgacctcggtgagaacatttcaatgttcgatcgttggtttcgcacgattacctcgcagcgaggtgagttgtcacgtgacaatcgacccagaacgtccggcgacgaccgctctgagtcgtttttgatccctgttgcgaccaaaccccgctgattgaacagatagatcggtataggaatgattcgtcactgttggctcgtcgcgaaaggccattctccggggcggttgtttactgagttgttacgtgacaactggagtgttgtttgaagagcgtgtgtgtcggatggcacgttaccctgcacgtcggtcggcacacacagtatcgaagagtttgatgcatcgattgatcgcagattccgccccttcgtcgccggcaatccgcattcatacccctaaaaacggaggggcccgcttactggaacagcactccgagcgcatacggtaagcatcattgatgtgtccccattttgcggaggacgttcagttgtattttcatcgaacgctagccagcaggggagggcgaggctttgtcgtgctacccgttcccgccggcgcagtatcagttttcgcacgacagccgtgcgtacgaggcttcgatttgcgacaaaccccagattgaaggtcgcgtgaaaactcaaacgggccagatcgtgaaacaatttcaagaaattcgatgctcgtggaagtccttatccagcaacgagttgcgcgatattcttcatgttgtttcacgcaatatcgacaagattgcgcttttaaatgggggcgcatgatcatttcgtgccccgcgtccgggagcacgcataaagatgtgttggcatgtatttattgatacgtattatgtagtgtttgaaatttatgtggcccgcctaggtatctgagacaaatcgaattccgcggatcacatacaccgcgacacgctgtcgagtctctgatcggatgtccgcgccaataatcggcgcgagttgtcacgtgacaactcgcattggttgctcaactcgttggatgacagagtgacgcgagaatcccggcgccaaagaatttgtggccgagcgctgggaaggccgccaagggactttgtcgttgaagagggggcgaagtcatcaccggctcatgagagcggcatggaacgaactgcttgtatctgtactttgctcgcgagttgggtgaaacatccgacttcgaggggcagtcacgcatcactcgatactcaattacaagtccccaggcggccgccgagccgtcagtcctgagtcggcaagaaatcgagaggcgcgcgtcccgctgcaagcgtgtgactcgcccggaccaagcgtggaaccgatccatcattctgcggataccgccaaaatcggtatcctgcatctccggtacgactccggcgatcagtaagttgccgccaccgacagaacgacatccgttccgctgcgcaggttatcgatatctcttcgcggcgaattgccgaacaaccgactgtattcgcggttgaactgggtcgggctcgcatatccaacccggaacgatgccgacgtggcgtcgagtcgctcggacaacatcagccgacgtgcttcgttgagtcgtatccatttctggtactgcagcggactcatgccagtgagcaggcggaagtggtgatggaaagtcgaactgctcatctgaacctgcgtcgccagatcgtcgactcgcagcgactcgtcgtaatgggttcgcaaccactggatcgcccgcgacacgcggttgccctgactgccggcggacgcaatctgacgcaggcggccaccctggtcgctcgtcagcagccggtagtagatttcccgctcgacgtacggagcgagaactgcaatggcgttgggatcatcgagcaacgccagcaaccggttgactgcgtcatagagcgattcggtcatatcgccgacgacgaggccgcgacctgcgggggcatcctcgtgatccggtgcgacctgcgccatcagttcggctatgacgcgaaaatcaagcttgagcccgatcccgagaaacggcgtttctcggctggcctcgatgacctgcgttgaaccaggcaagtcgagcgacgtgattagaaaacggttggcatcgcatagatacacatcgccgctttgaatgatccgcttcgtgccctggacgacgagcccgaagcttggctcgaccatgcagtccatcggctccgtcggtgtctcccttcgatggaggctcaggttcggaatggctgtggtgaggtggtcaacaccgtccgtccacctcgcgacgcgctctgcgagtgtcagccgcaggtcgctctcccggctctggcgggtcgatcgggagagacggggttgaatgcagcaatggtggcggcgtcgacctgttggccggggagtatggggcaggtgccggatgcatgacttctctactcgggtaatcgggtctacaggcgggcccatcgacatgcaggtacgccggaaacgagcttcccggaagctcggcattgccgcgctcccgggaaaatgcgcaacgtccggtgtacctacttcatcgcttgcgacgtgcaaagcggccagcggcgtgatttcgtggcaacggatggcacgcgctcgtccacagtgcgccaccaccgctcgccgcgatgcggctcgtccagagcgaggcgctcgcccatcctgggcgtcgacagttcgacgccacgcacgatcgccagcgccgtgacgcgctcgaacggttcttgccagcggtgcatcgcgagatcgaacgtgccgttgtggatcgggatcagccagcgtccgcgcaaatcgatgtgcgcctgcacagtttcttccggctgcatgtggacgtacggccattgcgcatcgtatgcgcctgtttcgatcagcgtgacgtcgaacggcccgaggcgctcgccgatcgtccggaaaccatcgaagtagcccgtgtcgccgctgaagaacacgcgcaagtcgtcgtcgacgatgacccaggatgcccacagcgtgctgttgccatcaaacaggctgcgcccggaaaaatgctgggcaggcgtggcggtcagcgtcaagccggcttcgtcgacactctgccaccagtcgagctgacggactttcttcgcgtcgattccccattcgatcaggcggtcgccgacacccagcgttgtcacgaacacaccggtggttgccgcgagcgcgagcaccgtgtcgcggtcgagatgatcgtagtgatcgtgcgacaggatcacgccgcgcagcggcggaagatcttcgagtgcgatcggaggcgcatggaaacgctttgggccgacgcgacgaaacggcgacgcgcgctcggcaaagacgggatcggttagccagaattcgccgcgcagcttgagcagcagcgttgaatggccgagccggtacaggctgcgatcggcggccgcgtctagttccgcgcgggtcagcgaatcgacgggcagcatccctgcgggcacggtattgcgcggcttgttgaacagcatgttccacgcgatgccgagtgtcttgcccaacccctcggccggccgggggcgacattgctgaagcgctcgccattgtgctgcggcgagccgccagacagcgtgcggccgcgtcgggcggccgcaaaacccagaatgcgatgaatcaaaacgagaggcgatgccatgtaggttcgtccggagaataaagtacactaaacagtgtagtttatttttgggtaagtaaactacgcggtgtaaaatttccgaatggataccagcactcccctcagcgcctgaccgatcgaaagcgcgcggccatcgtcgacgcggccatcgaggaatttctcgcgtcgggttacgacgcgaccagcatggatcgaatcgccgcgcgcgcggacgtgtcgaaacgcacggtctacaaccactttccgggcaaggaaacgctgttcgccgcaatcctgcaaaaattgtgggatgcgactcgaaccggcagctcgccaacctatcgttccgacgtgctgcgcgagcaattgctcgcgttgctggagcgcaaaatgcgcctgctcggcgacgaggcatttctcgcgctcgcacgtgtcgcgatcggtgcggccatccattcgccggaacgcgcgcgcgacatggtcgagcgtctcggcgagcgcgaggaagacatgacggtctgggtgcgaacggccgcggcggccggacgcctgtcggtcaccgatccggtgtttgccgcgcatcagctgcacggtgtcgtgaaggcattcgcgttctggccgcagatcacgatgggtcagccgccactcgcggcgccggagcaactaaaagtcgcggaatccgccgcagacatgtttctcgcgtactacgcgcgaccggaagactccgacgcatcacgcgccgcagcggactgatcgtgcatccggtcgatcatgcgcgaagcgaggccggcgcaatgcgcatgttcgacgcgcgccctggcccgacgagccggcaaaccggcagatccgcggatgcagaaccgcctcatatgatcgctggccatccagcggaacccggcgatgctgccggcttacctgaagccgaacgcgagtgacgacgcatgaagacgctgttgatcgtctatcacacgatgaccggaggcacgcaacagatggccgaagcggctgccggcgcggcgcgtgagcaatccggcgtcgacgtccggctgcagcgcgcggacgcgacgagcgcagacgatgtgctggacgccgatgcctatctgtttgcgacacctgagaatctcgcggcgatgtccgggctgatgaaggatttcttcgaccgctgctactacgcggcgctcgatcgcgtgaacggccgcccgtatgcggtgatgatctgcgcgggaagcgatggacagaacgccttgcgccagatcgaccggatcgcgacgggctggcggttgaagagcgtggcgccgggcctgatcgtctgtacgcacgcgcagacgccggaacgcatcctcgcggccaagacgatcgacggcgacgatctcgcgcgctgcgccgaattgggcgccggtcttgcagcgggacttgcactgggcgttttctgatcactcaggccgccgacagcctcggccggtcggcgtgaggccggaccgaagtacgttcgtgcacatgacgcgtgcacaccggtgcggtaccgatcctgcggtgcgggtactggactgacgcgactgcctggcgcttagctgcctttgtttgcgccgaaggccggtggtattcgggccaaaggcgtttcaccagatcgcgcgatgcgccatatgcatggcaactgtcgatcttgagcggctttccgtcgctgtcgcgctcctcgatcgatgacttccgcatgccgaccattgtctgataggccgtggtggcgatcgggccgagcaattccttcaagtgcgtgcacgtatcgcaggacggcaggcgcttgcgaacctcgctgttccagccggcgccgatgcgtaatccgacgagcgtctgcagcgagtcgccgccacccggacactgcgcatacggatgtgaccggaggaacgtggatacggcgcggacgatcatgtcggcgtcgaagaccaatgtcacgccgaggtcgtggatcggcgacagcgcagtgaccgttcgggtgccgcccggcggtgtgaaatcgaaagtcttgcgatccgcgaggcaggctgttacttcgaactggccgtcgctgcgccgatagccgcgcatgtcgatctgccggtggtgtatttcctcgcgcgtgatgccgtcgtgcgggatgtcatgtggggaaccatgtatctgctccgtttcgtgcaaccggttcttttcgccggcaagcgagatgtcgacggttggcccggtgcgcagcgaaacgggccgagggatacctccgccgccatcgatccggccatactacgcacttttcggcatcttcgtacgcgacgggatcgatgcggacgcaacgagtcgagtatggatatcgatgcgatcgacggaggcattcgcatgtcgcgatacacgcgccgatccgtcgccgggcgcttcacattggcgcaatcgtcgatttacacgcaaccgacggcgccgcccgggatcgcgaatgaggacctaggttcgcggcgcatcgatgcggcacgatcgcggcggcgccccaaggcggaatacctctcgtggggcgtcggccagtgccgccgccggggcaatcgcggcgcgcaagatggccccgatttccgccgacgagggtgaacgacgtgacttccggagacgtatccatataatgcgcaacacgaccgtacggatgcatttccggtaccccgaatcgggccaatgcagaccggtgagtcaaccggccgtcgcgcgtaccggtacttccactcctgccttgtccggcatcgtggccgggtgcctgaaaacagagtggcgtgcgcgatgcggccccgtagtgttccgcctcggcggcagacgggtcgcacgcatggcggcgaagcgggtgcgccgcgcggtgtgaccgcacgaaccacaccttatattcctggtggattgaatttatgggttttgaacaacttgccgaattgcgggcgcagctcgcagcgaaggccaagcaggagcgcaacgcgaagcggccggcagcgccggcggacaccggcgcgaagccgaagtccggcgaccagccgcagcgtggcgccaagccggctgcggccggcggcaaagcaccgcatcgcgcgaagcctgcatcggcgaagccgtcggcgccggtcgatccggtcatcgttgcgatcggcaaactgcagcgtaagtttccgcgtgcgttcccgaagaatccggccccaaagtgccgctcaaggttggcatctgggacgacctcgcgcgcgaagcacaggccgtcgggctcaacgaagccgaactgcgcgaagcgatgtcgacgtggtgccgcggcaaccgctactggtcgtgcctcgtcgaagatgccgtgcgggtcgacctgcagggcaacgaagcagggcgcgtcacgcatgacgacgcagcgcgggcgcgccggctgaaggctcgccgccccggcaagggcacggcgcaatccgccaagggcgcgcagcagcagccgaaggccgagcagcaggccgaggcggccgccgagccgcaaccggcgaacgtggaagcacaagccgacgcagtgccgcaggtcgagcagcaaacggccggaaacgagtaaccggcagcgcgcggctgcatgccgcgcggcgctgacccgcatgcacatcgcctgcggcaaacgacacgactgactgacctgcctcgacagaggcaggtcaggactcctcccaccggcgcctgacgcgccgggttcttatctatcccgcctcgaacagaccctgcaaccggacgaagaaagttcgtcgatcggtgctgcatgcgcgatgtctcgactgtgtcgtttgcgcgtggacggtacgcatgtccggaacgcgacgatgcttcatccagttaattcggtttcctaaaatggcgtaatgccggaagcatcgacacggcgtgagcgctcgcgcccggtcgtcctgacacgttgacgcgcgataatctcgccggggcacgtcggttcgttcgcaagttgacgggtgcgatgcagtttgcattcagaaaggtactgaacgccaactgcgacacaacctgaagccgctaccggcgccattcaacgtcaatccagtccgatcatgcactcgagatattccgcgattctcgtcgcgctcaccgctgccgcgctgttcggcgccgcgacaccgcttgccaaggcgctgatcggcgcgatgtcgccgttcatggtcgccggcctgttctatctcggcagcggcgtcgggctcggtattggtatcctgcttcgccgcctgcacagccgtcacgcaccggccgcagacgccgcgccgctgcagcgcgccgacctgccgtggctggccggcgcgatcgcggcgggcggggtggccgggccggccttgctgatgctcgggctatcgagcacgccggcggcgacgagcgcgttgctgctcaatctcgaaggcgtgctgacggccgtcatcgcatgggtggtgtttcgcgagaacgtggatgcgcaagtgttcctcgggatggtcgcgatcgtcgccggcggcacgctgctgtcgtggacgccaggccgggccggtgtgccggtcggcgcgttgctgatcatcggtgcatgcctgtgctgggcgatcgacaacaacctgacccgcaaggtggccgcgaacgatgcgatggtcatcgcgtgcgtgaaggggctgattgcagggcccgtgaacatcggcatcgcgctggcgaccggcgcgacgctgccggctctcccggtcacggccgccgcgatgctgacggggctcggcggctacgggatcagcctcgtgctgttcgtcgtcgcactgcgtcatctcggcagcgcgcgcacgggcgcgtatttctcgatcgcgccgttgttcggcgtcgtgctgtcgctgctgatctggcccgcgctgccgcccgcgacgttctggatcgctgccgcgctgatggcgctcggtatctggctgcacgttcgcgagcggcatgaacacacgcatacgcacgagcggctcgagcacacgcacccccatcggcacgacgaacatcaccagcatgcgcacgactttacgtatgacggcaacgaaccgcacacgcatccgcacgtgcatctgccgatcacgcacagccatgcgcattttccggacattcatcaccggcaccggcattgaccgcaccacaagcggcggacgaagcggcgcgtaaggtaaccgtttatggggcgtgcgctgcatcgcgctcgcatctgttggcggcgctgccgggtcgtggtcgcaacaacgggggcgagcctggtcttcgctctggatcaaccggggcggcaatctgtccggatcgatcggtgagccgactctgccgccccaggctctgtgcgtgggccggtgcgcgcgcggtcaaccggtcgtttgttcgggaatgccggctgcgagcacgtcgtctaagagcgtgcggaagttcgcgagccggaagcggcgactgaaccaactcgtcgccgcattgaatttgcggtacggatggaattccggcaacggggcgcagcgcttgatgtgtatccagccgcgagccgcggtcgtgccaggttgcagcgaaccccggttttgcgtagaagcggaaggcggcttcgaaaccgcacgccggcaggctggggccgcaatgccggccaacgcggcttcttcggatggcgatgcgacgaatcgaatcggcagcacgggctaccgtggcgactatcgcgcttgaggaaagcaggagccgaaatcctcgcagcccgggcaccctggcgccgggcccggcggcacatcgagcgatgccgccacttcctgcgcgaaaaatttcttccagcgcaggtgagcgacgttgcgtgcggcaagcgcggggaaatagcgaccaagcatcgcggataccgcgtcgcgcccgtcgagtccgagatcgcgccacagatgatcggggcgcaggcaggcgtgcgcgatgatcgacgcgagacagccggcgtcgtcgcggtcgacggcgggattcgcgtcgtccatcagccgcgcgtgcagcgtcgcgacaaacgcagcgtgggtggatggcagcagcgctgtcgcggccgtcggcacgagagccgcggcgtcggccgcaggcagacgcggaaactgccgcgccagcacggcggccagttgcggatgagacaggccgagcagcccgagttcgttgcggcgcgcacgtgctgcaacgagcgtgccgaacaggcgtgcgtcgggcgtgtcggcgtttgcggctgcggacagcagcgactgccgcgcccgttgtcgagcgtcatcgaacgcggcggtcatcgtcggcatcggcgcgacagccgcacggtgcgatccgcatgatccgcacgaatgcgcggtgccaaacggatcgccatcgccatcgcgatcgtcacgcgttcactcgacgccgacgatcacgctcgatgccttgaagatcgcggacgcagccgtgccgctcgcgaggccgaggcgatcgacgctgtcgttggtgacgatcgcgacgatctcggcgccgcccgcggccttgaccacgacttccgaattgaccgcccctttcgtgaccgacgatacggtgcccgcgacgcaattgcgggccgacaccttgctgctgtcgacgtcgaccatcacgatgaccgaagacgccttcacgagtgcgaacgccttcgagccggccgcgaggcccagcgaagccgcgctgccgtgggtgatcacggcgacgatgtcgagtccgtcctgcgtccggagcgtgatttcgtcgttgacggcgccggtcttgacggcgctgacctggccggcgaaatggttgcgggcgctggttcgcatgatggatctccgaaaatgaaccgcccggcgggcggcgagtaagagacggaaaagtgcggacgagtttaccttcaatgccggcccaatgcggctcgggtttgcgatgcccggcattccggtttcgcacggtcgcacggctgcccggggcgccatgcgtcggacgcttccggagagcccaggctggccgcgcgcgcgtcacccggcgagatgatcagcgaatggcgcgcgtagcgcggcaaacgcgctcctagttcttcaccggcaggttactcggctgcggtcacggcggccgaggccgccgacgcaccgcttgcgggtgccggcttcggcgtctgtttcgatatctgtttcgacgcgtcggatgccgcatcgtcatcccatccgccgccgagcgcgaggaagagccgcacctggtcggccgcgacctggccttcggctgccgccacctgcgcctgcacgctcgtcagcgtgcgcgttgcgtcgaggtcggagatgaacgactcgcggccggccacatagagacgatgcgtttcgtcggcggaactgcgtgccgattcataagccgtgcgcagtgcttccgtgcgctgcacgtcggccgcgtaggtcgcgaggctcgactgcgtctcgcgcagcgcgttcagcacgacaccgtcgaagtgcgcgagcgcgccgcccgtcgcggcttcggcttcgcgcactcgcgcacgctggccgttgacggggaacgaccagctgatcagcgggccgaacgaccagcgattcgtgttggacgagaacaggtcggcggcgacaccgaccgagccggccgacgcaccgatgctgatcgacgggtacagcgcggcggttgccaccccgatgcgcgcggtcgcggcggcgagttgccgctcggcttcgcgcacgtccgggcggcggcgcagcagcgcggcgccgtcgccgatcggaatcggctggcgcagcttcggcaggcgctcgcattcggcgacggccttcggcaggtcggccggcgagcgcgcgagcagcgcggcgagctggtattgcgcgaccttgcggcggccttcgaagcgcgggatatcggcggcgagggtgcgcacctgcgtcacgccgcgcgtcacgtcggtctggttgccgcgcccggcatcgcgcagccgctgcgacagcgcgacgcgctgcttctgcagcgcgagcgactgcttcgcgatggccagctcgtcgccggccgagcacgattcgacgtacgcgcgcacgacgtcggcgacgaccgtgatgcgcgcgagatcgccggcggccctgacggcctcgctgttcgcgcgcgcggcttcgacgccgcgccgcagcttgccgaacaggtcgatctcgtacgacacattgatgccgaccgcgccctcgttgacgaccggcagcttgttctcgagcaggtattgctcggccgattcctgcgcgcgctgcacggcggcttccgcgccgcccgagaagccgccctgctggctcgcgacttccagcgccgcgcgcgagcgcgcgaggttggccgcggcgacgcgcaggtcggtgttcgacttcagtgcatcgcgcacgagcgcgttgagcacgggatcgtcgtagagctgccaccagttgccgggcacggcgtcgcgcgacacgagcgtgccgttcgcgtcgtcgagcgcgtggttcgcgagcggtgcattcacgtacgcctgctgcggcagcgtgtaatcggggccgacggacttgcacgcgccgagtgccagcgcaagcggtgcgagcgtcgcggcgaggcgcagtccatgccgcttcattgcgatgctcccgttgcgctggcggccgtggcggatgccgtcgaacccggcgcgacggccgacgccgtgtcggcgcctgccggcttcgcgttgtcgttgcggcgcgtgtcggcttcgcgcatcgagacggtcgcggtgcggcccgcgatcatgcggaaatcgtcgggcacttcgtcgagcacgacgcgcaccggcacgcgttgcgcgagacgcacccagctgaatgccgggttcacgttcggcagcaggttcgcaccctgcgtgcggtcgcgatcctcgatcgcggcgacgatgctctgcacgtggccgcgcagcgtatgcggttcgcccatcacgatgatgtcgaccggctggccgatatggatgccgcgcagcttggtttcctcgaagtagccgtcgacgcggaacgaattgcggtcgacgaccgacagcaccgcgcggccggccggtacgtattcgccgatgcgcggcgcgcggtcgttcaggtagccgtctacgggactgacgatcgtcgtgcgctggaggttcagcttcgcggtgtcgagcgacacctgcgcatcggcgacggcggcttcaccctgttcgacgcgcgtgcggctttcctcgacctgttcgctcgcgaccaggttgccgagctgcaggttgcgcgcgtattcgcgcttcgcctgggcgagcgtcgcacggcgctgggcgagcgtggcttcggcgaggcgttccgcgagcgtgtagcgggcctggtcgatcacgaacagcacctggccgcgcttgacctcctggttgtcggcgacctgcaccgacgtgatgaggcccgccacgtccggcgcgacctggatcacgtcggcgcgcacgtgaccgtcgcgggtccacggcgagaacatgtagtagttgacgatgcgccacagcacgacggccgccacgacgacgacgatcagggtaagcaggatttgccctgccgagagccaggtttttcacggttagctagccacgagatggtgggaaacgatcacgacggcggcaaacacgaacacgtagatgccgaggtcgaagatcgaacggtgccagacgaggcggtagaagccgacgcgctcgagcacggcgcgcacgacgatgttgatcaggtaggcgatcagcatcagcacgagcggggccggcacgaatacgccgaagatgtcgatttcgccgatcatggtcgcggtcggaaagacggatgggaaagcgggatcatgcgcgtgctccgtcgggcgcctgcggcggctgccccgccgcggccggatacagcgacaggcgcaggccgacgagcgcgtgcagcgtgtcgcgcagccggcgatgcgtggcgggcgtggccggcgcagcgggcgcggcgtcgtgttccgccggcgtggcgcccggcaggttgcggcccgcgacgcgctgcagcgcgtcgtcgatggtcgcgagcagcgcgggcggtgccggctggcgcgcgttcgcggccgcgcagcgtgcgtagtggtcggtgacgccggccagcacgcggtcgatcgcgtcgggcacgtcgcccgacagccggcggcgcgagcggcgcaggtcgagcgcattcagtgcgatgcgcaggtcgcggaagctttcgatcgacggatgacggtggtcgtcggacgcgccgagacgcggcagcagctgcgtgacgcggtcgagcatccgtgacgcgtggttgcgctggtcgtcgagcggctgcgtcgacgcggagcgcgcgacgtcttcccagcccgagcgcagcaggcgccgcaccgcgagctcggcgccgaacggccgcgtcgcacgcgtccacacatacgcgaacagcagcccggcgacgcccgcgaggttgctgttcaggaacacgaagaaatcggcgtcgtacgcaccctggatgctgatgaaggtggccgtgttcacggcgacgagcatcgtcaccatgttgaactgcgggcgcggcagcagcgtgccgatcaggatgaacgggcccgcgaacatcacgacgagcatcgcgaaatcgtgcacgtgcggcagcacgacgaacaggtacaggcccgcgaacacgacgctcgcggtcgtcgcgaggaagaacttgaacaccagcggcgccggctcgtcgagcgcggcgaagaagctgcacgacacggccacgagcgtgacggccgcggcgccgtcgtgccatccggacgcgatccacagccagctcgcgaacacgatcgcggcggcgacggtcagcgtcgagaacagcatcatcccgcgatcgaagaagcgctcggtgccgccgagccgccagtgccggtagcgcggctgccagacgcccgattcgttgccgatcagcgcgcgcagcgagcggcagtcctgccagatgtcgatgacctggcgcagccgccacagcgcgttcgacagcagcgcgccgtcccagctcgcgagcgcgtcgtcggccggctgcagcgcggcaatccgttcgcgcaggcgctccgcgaccgggtcgtcggtcatgtcgccgtcgttgccggccttgaccgccggcaacggtgcgtcgaaccatttcgcggcatcggcgagcaggtcgtccagcccggccggccggatatgcaggtcgcgcatcagcgcaatcaacggatcggcgagcgacgacatcagcggcaggaacagctgcatccggcccgcgagcgcctgcgcacgcgcgaggatgcgcggatgcgcatggtcgtaactcagctggctcagcagaaattcgaggcccgtgatggttgccgcgagccgttgccggcacgcggacagcgccttgccggcaaggtgcccggacagcgtctcgcggccgtagaacgcggcgtccttgaaccatgcatcggtgcgctcgatcagcgtcggcgcgagccggttcgggaagatggcgctgccgaccacgctcgcgcagacgatgccgagcacgatctcctcggtacgcgcgatcgcgacgtcgaacacggtggacggatcggttacggtcggcaacgcgacgagcggcatcgtatagccggcgagcatgaacacgtagctgcgcgcggtgcggtcggagatcgcgaggtagagcagcgtgccgcaccaggtggcgacgatgatcgcgaacagcagcggtgtctcgacgaacggcggcacgaagaagatcgcggcagccgcgccgagcgcggtgccgagcgcgcgatacagcgccttcgagcgtgtcgcgccgacgaacgggttcgacacgatgtagacgctcgccatcgcccagtacgggcgcggcaactggaaatacaggccgaggtacagcgccagcatcgacgcggcgaacgtcttgcccgagaacagccagtcgcgaaggctcggataggtcatgacgtggcgttgccggtgcgggatgcgcgcgcggcgggtgggggcgattcggatgtattgaatgcgtcgagcacgcgcagcgtcgcttcgagatcggcgcgcgtgacacccttgagcacctgcgcacgcagcacgcgcaggtcctcctccatcttcgcggtgaccgcgcggccggcggccgtcagcgagatcgtcttcgcgcggcgatcgtgcggatcctcgtcgcggcgcgcaaggccggccgcgcacagctggtcgagcaggcgcacgagcgacggcccttcgatgccgacgtgttcggcgagcgtgccttgccgcacgccttcgccgaggcgcccggcgatcagcagcggtgtcgcgcaggcctcggacacgttgtacgcgttcagcacgccgtcactggtgcggcgccacttgcgcgcggacagcacgagcaggctgctgacggcgaggcggaggtcgtgcagattggtcatgggcgagatgataggggcaaaataattcgatagcaaactatcgtttttgtcacccgtatgacacgtcgcggtcggcccgtctgaagcaatttaggcggcgtgccggcggtggtcaagccgcaaggatgtcggcccggcccgcgcacggcgaccgcgatcgaatgatcggacgaaagccgtcccgcgcggccacgcggcggggcaggcgggttagaagccgggattcgggaaatccggcttcgcgaaacggcgcgcggcgtgcatattgaagccgttgcaagcctcccggagattccgcacgtgtccaccccgtcctcgcagccgtccgccccggcgtcgctcgacgcgtggctcggcaagaccgaaacgctcggcgacgacatcaccgcgttcccgctgaacgcgctggccgccacgctcgaccgcccgtcgcccggcgacgtcgtgccgccgatgtggcactggctctatttcctgcccgtcgcgccgctggccgaagtcggccccgacggccacccgaagcgcggcgccttcctgccgcccgtgccgctgccgcgccgcatgtgggccggcggccgcctgacgttccatgcgccgctgcgcacgggacggcgcgcgatacgcgaatcgacgatcgtgaacctcgaggacaagacgggccgcagcggccggctcgtcttcgtgacggtgcagcaccggatcgagtgcgacggcgtgccgtgcgtcgaggaggagcacgacatcgtctatcgcgatgcgccgcaggcgggcgcacccgcgccgaagccgatcgcggcgccggcaggcgaggcatggtcgcgcacggtcacggccgacgcggtgatgctgttccgctattcggcgctgaccttcaatggccaccgcatccactacgaccgcagctacgtgacgcaggaggaaggctatccggggctcgtcgtgcacggcccgctgatcgcgacgctgctcgtcgatctcgtgcgccgcgaacggcccgatgccgcgctcgcgagctttgcgttccgcgcggtgcgcccgacgttcgacggggagccgttcacgctgtgcggcaagccgtcggacgacggcaagacgatcgagctgtgggcgaaggatcgcgacggctggctgacgatgcaggccaccgcgaccgttgcgtgacgggcgccgtttccgttcgtccgcgtcgcggcaggatccgtacgcggacgaccggtggtgcccgccgcagctgctcgggcgggcatgcgggcgggctccggcgctcgtcgcgaaaccgctgtaagctgcgagcaggccgcgtgccgtcctgccggacggtgcggcgcgcggccgacccttccaccttccacgcatcgcatcaggagcacgtatcttggccacctacattgtgtttacacgtgaaagcacgcaggaccagcacgaactcgacgtctaccagagcaaggtcggcgcgacgctcgccgggcatccggtcaaggtgctcgccgcctatggcccgcaggaaacactggagggcgaaggcccggaaggtgtcgtgatcgtcgagtttccgtcgaaggaagccgcgcacgcgtggtatcacggccccgaataccaggacgtcgtccagcatcgtttcaagggcgcgcgctatcgcgccgtgctggtcgaaggcgtctgaacgacccgcatcgggcgcccggcacgaccatgaacacatcgacccccgccactgcgaccgtccgaccgccgatgggccgcgccacgaccgtgctgctcgcgatcagcgtcgtgctctatctggtcgccatgttcaccgtgccgttccgcacgggcgcacccgatccgcatccctgggccgacggctggcaggtgctgctgaccggctggatgggccttttctttggcatcttcgcgtggctcgcgaacccgctcgtgttcgcggcctggtggctgatcgcgaagcgccggcgcacgcaggcggtcacgctggccgtgctcgcgctgctgttcgggtcgagcttcctgacgcagcatcggatcgtcgtcaatgaagccggcggggtcgagccggttcatctcgatgcaatcggctactggtgctggctcgcgagtttcggcatggccgcaatcggcgccgcgctgctgccggggcgaaccgggacgcgtgcggcaggttgatgcgggcggcccgcatcagcctgccgccaccgcttatcgcacgtgcggctgcaatgcgcgcaaccagtacgacaccgccaccgcaccgccatccggcgtgccgatcgcgcgctcgccgagataactcgcgcgcccgcgcgcggcgtcatctgcgcggtttcctgcgcaccgtgctcggcggcttcgaccgccgccgcccatgcgcccgcgggatcgcgatcgttgtcgagcgcccgttcgaatgccgcgacggccggcaccagcgcatcgagcatcgtccggtcgccggcgtgcgcgccgcccagttcgctgatcgagtccaccgcgccgtggaacgccgcggcccagtcgcgtgccgacggctcggcgacatcggccagccggcgggatgcgcgcagcagcgcggtcgcatagaacggccccgagctgcccgcgatggcgcggcgcaacgcggcgccgagcgcagcgagtacgccggccggcgagccgtacgcggtttccggcagcgcgaggatcgcctgtgcggcgcgcagcatgctcgcaccgagatcgccgtcgccggcggccgcatcgaggtccgtcagcgtctgctcatgatcgatcagcgtctgcgcgaccgcatgcagtgccggttgcaggcgtgccgcccacgcgcggccggtcgcatcgagcggcggcagcggcgcttcttgcgcagcggcctcggccacgcggatctgcgtattcaccgcgccgccgcccggccatgcgcgcgcctgcgtcggcgcgtcgagcagcaccgcgcgttcgtcgttcagccgcagcacggaaatcgagcagccgggcatgttcaatgccgacaggaacgtgccggcccacgcgcgtgagacgacgatgccgcgccgcgtcaggttgtcgtgcgcggcgcgcagcacgatggcgagttccatgtccggcgtcgcgccgaggccgttgacgaacagcgcgacgcgttcgccgcggtcgagcacgagatcggcgacgatgctcgacagcagcgtgtcggccagcgtatcggccggcagcggcgcgcggcgttcgacgcctttctcgccgtggatgccgaggccgagttcgatctcgtgatcgccaaggctgaagcccgacttgtcggcgccggggatcgtgcagccgtcgagcgcgacgcccatcgtgcccagctcggccgccgcgtcgcgcgcgatggccgcgacccgtgcgagcggcagcccgcgcgcggcagccgcgccggcgagcttgtggatcagcacggtgccggcgatcccgcgccgctggccgcgctcgacgcggccgcgcagcgagacgtcgtcggcgacgatcaccgtttcgaccggaatgccttccgcgcgcgcgagctcggcggcgagcccgaaattgagccggtcgcccgtgtagttcttcacgatcagcagtgcgccgttcgggcccgcgctggcgcggatcgcggcgagcaccgcgtcggtggacggcgacgtgaacacttcgccgcagacggccgcgctcagcatcccttcgccgacataaccgccgtgcgcgggctcgtggccgctgccgccgccggagaggacggcgacggggcgctgtgccggctcgggcagcggctggcggacgagcacgtgctcgtcgccgaggatcgcgacatgcggcgactgccgcgcgatgccttccagcatttctcggacgacatcggacgggcggttgacaagctttttcatggcgacgggttccggacgggtgaacgaggcacggccgggcccgcacgggcgccggacggcctttcgtgttgcggaggatcgtgcgtgcgccctgtcgccgggcccgggcggtcatgcaacggacggccggatgcgggaggaacgaggcgcgcgcctcgcgccacgatacatcaggttcgaaccttgccgcacggatcgcggcgcgaaacgcaccggagcggggcggcggcgtgctcccatgcgcggctacttcattgccgcgatctccttcgcgcgaatcagcctggcgcgcagcacgttgcggctgatgccgagcagccgtgcggcctggatctgattgcggtggctgaaatcgaacgcaacgcgcatcacggtgtcctcgatacgctcgaacaggttgccgtgatcctcgtcgaacagcgcacgcaacgcgcgttcgagcgcagcctgcgcgccggctgccgggtcgggttcctgcgccggtgcatgcacggcggccgtcgcgtcgggcgacgcgagatgcaggtcggcctcctgcagtgcgtcgtggcggctcacgagcagcgcgtgatggatcacgttctcgagttcgcggatattgccgggccagccgtatgcctggagccggcgctcggcgcgcgggtcgatgctgcgcggcccgtagccgaggcggctccggtagtcgtcgaagaagtggcgcgcgagcggcaggatgtcgccggggcgctcgcgcaacgtcggcaccgcgagctgcacgacgttgagccggtagaacaggtcgccgcgaaactgcccgtgcgcgacggcctgctgcagatcgacgttggtcgcggcaaccacgcgcacgtcgatcggcacgcccgtgcgcgagccgaggcgcacgacctcgcgctcctgcagcacgcgcagcagcttgacctgcatcgacagcggcaggtcgccgatctcgtcgagaaacagtgtgccgccgttcgcggcttcgaaccagccgggcttcgcgctgaacgcgcccgtaaacgcgcccttctcgtggccgaacagttcactctcgacgagcgtctcggagaaagcgccgcagttcaccgcgacgaacggcccgttgctgcggcgactgaggccgtgcacgtgccgcgcgatcagttccttgccggtgccggtttcgccgacgatcagcacgttcgcgtcgctcggcgcgaccaggcgaatccgttcgaggagcgcgaccgagcgcggatcgacgaacacctgcgcgcgggcgcgaatggacgtcgccagcgcgggccggtcgggcagcgtgaggacgggcgcggcgtcgggccacgcatcggaaggagcggttcacgagtagaagcccggcgtcggccaggttcgcttgagcgcccattcgccgatctcgcgaatcttgtacgcgagcggatcgtggagcgtatgggtgcgcaggttgcgccagtgccggtcgagccgcagcgcgccatgcgtcgcgcgcgcgccggcgacgtcgaacatgcgcgtgcagagatcgagcccggtgcgggtggccgacacctttgcagcggccgtggcgagcgcgacctcgccgcgctccgcatgcgtgagcgccgcatcgcgcgcccacgcggcgtcgaggcgatccgccgcacggtcggcgagcacgcgcgcggcttcgagcccgacccagaattcgccgtactggccgaggatgtacggatcgtcgccggtgctcgcgacctgcgcgccgggccacggccgcgcttcgtgcagcgtgtagtgccgcgcgtcgctgaacgcggcttcggcgatgccgagatacacgttcgtcagcacgagctgcgcgacgagcgggcgcaggcacgcgaacggcgtcgacagcgggccggggtccgtcagcagttcgtgttcctcgacgcgcactttctcgaacgtgaccgtgccgctgtcggtctggcgctggccgatgttgttccagtcgtcggcgatcgagatgccgctgcgctgcgtcggcacggccgcgatcaggaacgcgcgcgtctgcgcgtcgtgcgcggacgcgatcagcatctgcgaatcgagtgcccccgaacaaaagctcttctggccgctgaactcgtgccatgcgccgcgcgaacggctgaccgtgcgttcgtcgagcggattcagcgcattgccccagaaccactgctggcgcgcggttcgctcgaaccacgattcccactgcgcgggcgtgccgaacagccgcacggtcgcgagcatcaggtgatggaagccgaacacgtgcgcgagcgaactgtcggcggccgcgagcacgcggaccgcgtcgaacgtcgtgcgccagcttgcgccgaggccgccgtaggcggcggggatgctcaacgcgaggaggccgctgtcgcgcaactggtcgcgctcggccttcggcgtgccgccctgctggtcgcgttcggccgcagttcgtgcaaagccggccgccaggcgcccggcggtttgcagcgcgtcgggaggggacggttcgtcgcgggacggcgcgacgacgcgcaggctttccgcgcggggcgatacggaaatggatgtcatggcgatgaatgcgtcgggtcgctgcacgaaaacggccaggctgcatcggtcgttgccgaccgggtgctgcgtgatcagcagagtgttcaacgttttgcgcaacgcgggaaacatcgatttctgataaccaatgccggattgctgcgctggacgctgcgcacctgccggaatccgtgcagaagcggaaaaatgcgtccgccgcacactgcgctgctgattacgcagcagtgcatcagcagcgctgtttccccagttcatcgtgctgcggaatatggttgtgatgccgtggctggcacgcttatcaacgtgtgtcgatcggcgggcgcgccacgacaggccgtcgatcgcgatgcatttcgtcatgcagacgatcgctttttcatcgccgtcgtcgaaatggcacgctccttgctgacccatgacgtggcgggtgcatcggcacccgattcgacaatgggaatgcaaccgatgagcaatgcaatcaacgtggtcgcgatatcgggcggcctgcagcggccgtcgcgcacgctggcgctgaccgacgcgatcgtcgcggcactcggcgccgcgctgccgatcgacacgcggctgatcgaactcggcgagatcggcagccggctggccggcgcgctgacgcgcgcgcaggtgccggccgacctcgacgcgcagatccgtgcgatcgagacggccgatgcgctcgtcgtcgcgagccccgtgtatcgcgcgtcgtacacgggcctcttcaagcacctgttcgaccttgtgcatcacgaggcgctggtcgacgtacccgtgctgctcgccgccaccggcggcagcgagcgtcatgcgctcgtgatcgaccatcagctccggccgctgttcagcttcttccaggcacgcacgctgccgatcggcgtgtatgcgtccgaaagcgatttcgaccagtaccagatcgcgagcccggcgctgcgtgcgcgcatcgcgctcgccgtcgatcgcgcggtgccgcagctgcgcccgcatgcgctttccgtcgcggccgcctaggccgcctgcgttttcccttccgaccaggacacactcatgagccataccgacccttccgccgacggcgtcaagttcgcctactgggtgccgaacgtcagcggcggcctcgtcgtcagcacgatcgagcaacgcaccgactggagcctcgaatacaaccagcagctcgcacgcacggccgaggcggccggcttcgagtacgcgctgagccagatccgcttcacggccggctacggcgccgaataccagcacgagtcggtgtcgttcagccaggcgctgctgcacgcgacgacgaagctcaaggtgctcgccgcgatcctgccggggccgtggcacccggccgtggtcgcgaagcagctcgcgacgatcgaccatatctcgaacggtcgcatcgcgatcaacgtcgtgagcggctggttcaagggcgaattcaccgcgatcggcgagccctggctcgagcacgacgaacgctatcggcgctcgaaggaattcatccaggcgctgaaaggcatctggacgcaggacaacttcacgttcaagggtgatttctaccgtttcaacgactacacgctgagcccgaagccggtgcagaagccgcatccggagatcttccagggcggcagctcgcgcgcggcgcgcgacaacgcggcgagcgtgtcggactggtatttcacgaacggcaatacgccggagaacctgaaggcgcagatcgacgacatccgcgcgaaggcggcggcgaacaaccatcgcgtgcgcatcggcgtcaacgcgttcgtgatcgcgcgcgatacggaggaagaggcgcaggccgtgctcgacgacatcatccggcacgcgcacgtcgaggccgtgcacgcgttcggcgatgcggtgaagcaggccggcaaggcgtcgccggagggtgagggcaactgggcgaaatcgacgttcgaggatctcgtgcagtacaacgacggcttccgcacgaacctgatcggtacgccgcagcagatcgccgaacggatcgtcgcgctgaaggcgatcggcgtcgatctcgtgctcgcggggttcctgcatttcatcgaggaggtcgagtacttcggccagcgcgtgctgccgctcgtgcgcgaactcgaggctcaacggcaggcggttgccgcgtaatgcgacggcgcggtgcgcggcgggcacgaacgcgtgccgcgcaccggccgatcgaaggggcgacaccggcggttctcgcgggtcgacccggtttgacgtttcggatatcgaaacaggaggtcggcggatgcttcccggcgccgccggccggttcatgagctttgccggaatcgacatgtctacggaaatcatcgaagaaaacgtgcaaccgcaagcgggcgccacgcccgttcccgtcatcggctcggatgccgaggcgctcgacgtcgcgcgtcaggtcgcggcacggctggccgagcacgccgcgctgcgcgaccgcgaccggaagctgccgttcgacgagatcgaactgttctcgtcgagcgggctgtggggcatcaccgtgccgcgcgaatatggcggcgcggaggtgtcgaatgtgacgctcgcggaagtgatcgcgatcgtttcagaggcggacccgtcgcttggccagatcccgcagaaccactattgcctgatcgaggacatccgcctcgagggcagcgatgcgcagaagcgcttcttcttcgatctcgtcctgaagggcacacgctacgggaacgcgttttccgaagccggtggcaagaacgtgctcgatatccggacgcgcgtgcatcgcgacggcgatgcgttcgtgctgaacggccgcaagttctattcgaccggcacgctgttcgcgcactggattccggtactcgcgctcgacgagtcggaccaggccgtgctcgccttcgtgcggcagggtgcgccggggctgaccgtcgtggatgactggagcggcttcgggcagcgcacgaccgcgagcggcacggtgatcgtcgagaacgtgcgcgtgagcccgttcgaaatcttccacacgcagcgttcgtacgatcgcccgaccttcgcgggcccgttcgcgcagatcacgaccgccgcgatcgacctcgggatcgcgcgcgccgcgctgcaggacacgatcgcgttcgtgcagcagcatgcgcgcccgtggatcgacagcggcgtcgagcgcgcgagcgaggacccgctgacggtcgcgcagatcggcgacatcgcgtaccgcgtgcacgcggccgaagcgctgctcgcacgctcgggccgcttcgtcgacgcggcgaagcgcgagccgggcgaggaaacggtcgcgcaggccgcgatcgcggtgggcgaggcgaagatcgcgacgaccgaagtggcgctgcttgccgcgagcaagctgttcgagctcggcggcagcaagtcgacgctggcgaaatacaacttcgaccgccactggcgcaacgcgcgcgtgcatacgctgcacgacccggtgcgctggaagtatcacgcgatcggcaactactacctcaacggcgtgaagcccgcgcgccactcctggaactgaccggctcgcgccggccgccgtcaccaccctcaccatcaccactaccaccgccgcggacggcacgtacgcggcgccgcttcattcctgacgaggtcaatcgatgagtcatccagcaagccccgcgcaggcactgcccgcgcagcatgccgcaccgccggcgggcggcctgcggcgcaactacctgagcctgcccgaactgattgcgcagtcgatcggcctcgtcggcgtgtccggcgggatcggcgtgctgatccccgccgtgttcgcgacggccggcaacggcacgtggctcgcgtacctgttcgcgatcgtcgcgctgctgtttgcgtcgtggagcatctcggtgttcgcgcgcgattcggcgtcgccgggggcgctgtatgcatacgtgtcggccggcatcgggccggtctggggcgcgatctgcggctggtcgctgctgattgcctatgcggtggccgccgcgggcatcctgcaggacgatcaacacgtttctcgtgctgggccgcgagaccgggctgctcggcggcgcgacgccgctcggcgcggtgctcgggctcacggtcgtcaccgcgttcgccgcgtggtacatcgcgtttcgcgacatccggctgtccacgcgtttcacgctgttcgtcgaactcgcgacgctgctgctgatcgccgtcgtcgtgatcgggacgatcgcgttcggcgggcatccggtcgatcgcgcgcaactgacgctcgaaggcgtgaagccgacccagctgcagctcgggatggtgctcgcgttcttcagcttcacggggttcgagagtgcgaccgtgctcggcgcggaagcgcgcgacccgtttcgcgcgattccgcgcgcggtgctgatcagcgtcgtcgggccggcgatcctgttcgtgatcggtgcgtacgggatggtgagcgcgttccacgggcagacgccgccgctcgaccgggtcgacggcccgctcgcggtgctcgcgcatcggctcggcgccggctgggtcggcgtgctgatcgacgcaggcgtggcgttgagcttcttcgcggcgttcttttcgtcgatcaatgcggcggcgcggatcgtctatacgttcgggcggcagggcgtgctgcatgcgtcgacgggccacgcacacgagcgcaatgcgacgccgcacgtcgcggtggcgctgatcgcggtgctggcactggtcaccgcgctggtattcaccgcgcgcggcaccgcgctactcgattcgtatggctatctcagctcgattgccacgtacggctggctgcttgcatacgtgctggtggcgatcggcgcgccgctctatctgcgccgccagcgccggcttcgcgcgcggcatgtggcgatcagcgtcattgcggtcgtgctgctcgcgattccgctggccggcagcgtgtatccggtgccggagggcgtgtatgcgtggctgccttatgtgttcgtcgcgctggtggcgatcgggctcgggtggttcctcgtgctgcgcgtccgctttccggagaggctgagcgagctggaggccgagttgctgacgaagtgacggggcgcgccgtcggacttcggcgcgccggtcggctggacggtgcttattcggtcaagtcgaaatcttcttcgcggccgttcagtatcgcggtcagtgtccgcagcccggcgtcgagctggtccatggtcggcgcggccagtgcgagccttaccgcgttcggtgcatggccggacgagacggcaaacgtggtcgacggcgtcagcccgatgtcgcgccgggccgcggccgcgaccaacgcctgtgagcgccagtgcgccggcaaggtcagccacaggtggtagcacttgccgttggtccggatatcgaaccccgcgagacgatcgattgccagcgcctggcgcttgctcgcatcgatgcgcttgagttgcgcgagctcggccacggtgccgtcgcgcatcaaccgctgcgcggccgcgaacgcgaatcccgaggcggtccacccgcccgagcgtaccgatgccatgacgctttcgcgtagccgcggcggcggcacgatgaatcccagggtcatgccgggcgtgaccttcttggacaggctgtcaatcacgatgcaggcgtccggagcgagcgcggccagtggcggttcgtcgccgaggaagccgtacacgttgtcctcgatgacgggaatgtcgagcttttcgaccacgcgtaacagttcggcgcgacgcgcggtgctcatcgtcatgcccagcgggttctggatggccggctggatatagattgccgacagcctggcttcacggtgcgccttttgcactgcgtcgggacgcacgccgtcatcgtccatcgccagcggtaccagcgagatgcccagtttggcggcgatgcccttgatgaacgggtaggtcagcgcttccacgccgcagcgcccgccggtcggaacgaccgcggccacggctgcggcaatgctttggcgcccgttgccggtaaacacgagctggtccggcgacggcgaccatgccggttgcgacagataggcggcggctacgcttctgatggccgcggtgccgatactggtggcctcgcgcagcgcggcatcgagttccgccggtcggcgcaatccgctcaggcttcgtgcaatcaacgccgtttgatcggggacgctcggatagttgaactcgagatcgatccgtacgccgcgcggttccccgggcgccgccgccccgcgccgcgtctcgcccgacacgaaggtgccgcggccgacttcacctaccaccagcccgcgtcgcaagagctccgtgtagacccggcccgccgtcgatgcggcgattgcatgctggtcggcgaaaagacgctggggaggcaggcgatcgccgggcgccagtgtgccgtcggcgatttgcgcggcaatcgcgtcggccagttgcagatactcggatttggacatggattgcaccgataacaatgattattgcaccgaggtcaatgttttcattgcactgagatatgaggcggtgcattctgatttcagcgagtcgattgtaccggggctgcaacgcttgtacgactcgggcagcaggcagtgcacctgaccggcgcactgcatcgccccggcatacccattggagaggcagtatgcatggagcacgttcaaccctgatcgctcgcatggcggcgacgcagctacgggccggctcgcggcagcccgccgtgtggcgttccgtgtcggcgagtcggccatgacggccgcaccggtcgcggtggggctgcaactgacgctgaccaccatcctgatcgcgttcgcgggcgtgttcgtgatcgcgttcatgcgcggcgcgttcggcggtggattcgcgatcatcggcataccgctgctgtcgctcgtgatggacccggtgaccgccggcggtctgctcgctccgctgttcatcgcgatggatctgttcgcgctgcggtactggaagccttcgacgtggtcgaagccggatctcgttctgctgctgcccgggctggtgatgggtatcggatgcggctatctggcatttcggtttctcgaccatcgggccatcgaactcctgatggcggcggtcacgctgatattcgtcggcctgtgggtggccggcggcgcgcagctgacggtccgtccgcgttcgcgaccgaaggccgtgaccgccggtctcgcgtcgggcgtcacgacgatggtcgcgcattcgggcgggccgccgctcgcgatgtacctgctgccgctcggtctcggcaaggagatgtacgcgggaacgacgagtcttttctttaccgtgggcaacgcgctcaaggcggtgccgtggatgctgatcgtgcggccgaccatgaacgtctgggcattgatggcggtctgcctgctcgccgttccggccggcgtggtattgggctggcggctgcacggcaggctggaccagcgcctgatctatcggatctgctacggattgctggcggtgaccgcgctgaaactcttctgggacggcgtttccggctatctcgcgtgaagcgggcgcactggcgcccgttcccggtgccggtgcgaagttcttgcgaatgacaggtaatcagtagtgcagatgtcgttcgtccgaccaacaggagcgtgtatgtcgactgatacttctttgcggacgccgtcgcggcgtcgtttcatgggcgtagccgcgaccgccgcggtggcaggttcgttgagccgcctcacgtttgccgaaaccgaaaccgcagcgagcagggccgtcgtgggcgttgcccgaccggccggcggcgacgcgtccgccgtgcgcccgctgcgggtgcatgcgccggacgtgcaacttgccgagctgcggcggcggatcaacgcaacgcgctggcccgaacgggaagcggtcgccgacgcatcgcagggcgtgcctctcgagacgatgcagaaactcgcgcgctattgggcgaccgactacgactggcgcaaggtcgaagcgacgctgaacgcacttccgcagttcgtcacccggatcgacgggctcgacattcatttcatccacgttcgctcgaaacatccggatgcgttgcccgtcgtcgtcacgcacggatggcccggctcgatcatcgagcaactgaagatcatcgggccgctgaccgatccgacggcccatggcggcacggcatcggacgcgttcgacgtggtgattccatcgttgccgggctacgggttctcgggcaagcccgctgcgaccggctgggatcccgtgcgcattgcgcgtgcgtggatcgtcctgatgaaacgcctcggataccggcgttacgtggcgcagggtggcgactggggtaatgccgtgaccgagcagatggcgctgatcgcgccgccggagctcgtcgcgattcacacgaacatgccggccacggtgccggacgatatcgcgaaggcactcaagtccggtgagcccgcgcccgccggtttgccgccggacgaacggcacgcgtacgagcagctcgatcgtttctacaggcacggcctcggctatgcgcaggaaatggcgaaccgcccgcagacgctgtacggcatcgaggattcaccggtcggcctcgccgcatggatgcttgaccacgacgcgagcggcctcgcgctcatcgcgcgcgttttcgatggccataccgagggactgacgcgcgacgacgtgctcgacaacgtcacgctctactggctgacccgcacgggcgtctcgtcggcgcgtctgtactgggagagcaagctcgaattctttgcgccgaagcatgtgactatcccggtggccgtgagcgtgtttccggatgaaatttacgccgcgccgaagcgttgggcgcaggccgcgtatccgaaactgattcactacaaccggttgcccagtggcgggcatttcgcagcctgggagcagccgaatgcgctgtcggaagaactgcgtgcgagcttccggtcactgcgctgaacacattcgcccgaccgtatgattcgcggatcacgccacacctgccatcctcgacgcatcgaccaccatctgcacgccgagcccgccgaggatgagccccatcgcccagcgctgggcgagcagcagcgtcgggcgcccgtgcaggaacttcgcgatgctgctggaacagatcgccaccgtcccgttcgcgcaggcgaatgcggcgatcagcagcgaaccgagaaacagcgactggccgagcacgctgccgttccggtagtcgatgaactgcggcagcaacgaaatgaacagcatcgcgagcttcgggttcagcacgctggtcgtcgcgcccatcgcgagcagccgcagcggccctcgctgggcaacgcccgcacctcgaacggcgagcggccgccgggcctgacggcctgccatgcgagatacagcaggtacgccgcaccgaccacggccagcccgctgcccgcatagggcacgctcatgaacagcgtcgtgatgccgaacgccgcgccgaacatgtagaacaggtacccgatcatcacgccaccgagcgaaatgagccccgccgtgcggccctgcgcgatcgagcgcgacatcacgtagaccatgttcggcccgggcgtgaccgcgagcatgccgccgatgacgagaaacccgtagagcgatccggacgtatgcatgtctgacgattcctgcaacgagtgagtgctgacgggagtcattgtccgatcgtggaggcgaacagtaaaacgggataaactgaatcgattgatcaggttttctgaatacgatgaaaaagctcgacctcgatgtgctcgcgatggtggtggccgtcgccgaatccggatcgttcgctcagggcgcgcaggccgtgcaccggtcgccgtcggcggtgagcatgcagatcaaggcgctcgaagatgcgctcggcaagccgctcttcatccgcgacacgcgcaacgtgacgccgaccggcgaaggcacgatgcttgcggaatacggccgccggatgctggcgatgcgcgacgaggcctgggcgtcggtcgtgcgcccggagattcgcggccgcgtgacgatcggcgtgcccgacgactacatttcgtcgctgctgccgcaggtgctcggcaagttcgccgcgatgcatccgcgtgtggaagtgcgcgtgatcggccagccgagcagcgcgctcgtgccgatgctgaaggacaacacggtcgacctcgcgtgcctcacgcggatcaagggcgtgaccggcgagctgatccggctcgaaccgctcgtgtgggccgggtcgccgaaacgcaacgtatgggaggagcggccgctgccggtggcctttttcacgcacggcggcagcatggcgcgcgatcaggcggtcaaggcgctgaaccggcggaagatcccgtaccggatgtcctacgagagcccgagccacctcggcctcctcagcatggtggaggccgggctcgcggtcgcgccgctggcgcgctgctgcattcccgatcatctcgtgcagctgtcggaaagccacgggctgccgccgctgggcgaactcgaggtcgtgctcgcgcgcagcgcgcagtccgcgcgcccgccgtgcgactacctggccgagcagattctcggcgaatggcgtacctgaacgcgggcggcccgccggcggccgtgtttcagcacgacttcagcagccattcgcggaacgcgacgagcgacggcagcgtctcgttccccggcggatagacgaggtagtagctgcgctggctggtgatcgcgtcgccgatcgacacgagttcgttgcggcccagctcgtcttccaccagcaccttcggcaccagcccgatccccatcccggcccgcacggcctggatcaggtgtgacgtcagctcgaagctcgggccgatgcgcatctgccgatggtcgagccgatagtgcgaaaaccactcggcccacgcctgctggttgctcgtcacgccgagcagcgtctgtttcgcggcccacgccggcgaacgcgcgtcggccttgcggcggctgccggtgtccggcggcgcgatcgcgatcaggaactcgttgtacaaccggtgcgcgtgcaggcccggccagtcgcccgcgccgacggtgatggccgcatcgaggtcgtcgttgaggaaatcgatggcgccgatccgcgaatggaggtgcacggtcacgcccggatgcgcggtgtagaagtcgtgcaggtgcggcaacagccatttcgagccgaacgtcggcaaggtggcgagtcgcagcgtgccggcgcccgcctgatgggacatcgcttgcagcgtcgcaccgcggatgcgccccagtgcgccgctcagctcggcgaagtagcggcgcccgacctcggtcagcttcacggagcggccctcgcgccggaacagcggcacgccgagttgatcctcgagcgtctggacttgccggctgatcgcgctctggctcagcgacagctcctcggccgcgcgcgtgtagctttcatgccgcgcggcggcctcgaacacgagcagcagcgacatggacggggtgagacgacggtaattcatgagttttatgcaatattcgccgggtgagaattcgtttgtttctcacggaaattccaaagatactggaattcccggtcgcgcggaaacttgccaaaaatcatgtttcggagcgcgcgaaccggccggctccacccacacagcgcttttgccccatgtcgatcgcctcgttgccccgtcccgccagcccgcccgcgaatgcgtaccgtgactttctcgccgcgctgcgtgccgccggattcgccggggagatccgcgcggaccatgcgaaccggacggtgcaggccaccgacaactcgatctaccagcgcctgccgcaagcggtgatctgccccgcgcatgccgacgacgtccagctgctggcacggctgctcgccgagcccgcgcatcgcgacgtcgcggtggccgcgcggcggcggcacgggcaccaacgggcagtcgttgaccgacggcgtggtcgtcgacctgtcgcggaacatgaaccggatcctcgaaatcgacgtcgagcgccgctgggtgcgcgtgcaggcgggcgtcgtcaggatcagctcaatgcggcgctgaagccgcacgggctgtttttcgcgccggaactgtcgacgtcgaaccgcgcgaccgtcggcgggatgatcaacaccgacgcgagcgggcagggcagctgcacgtacggcaagacgcgcgatcacgtgctcgaactggatttcgtgctgatgggcggcgagcggctgcacagcgacgcactcgatgacgaagaactggagcgccgctgcgcgcggcaggaccgcatcggcaaggtctaccgcaccgcgcgacgcatcagcgacgacaaggccgcgctgatcgaagcgaagtttccgaagctcaaccgctgcctgaccggctacgacctcgcgcacctgcgcgaacccgacggccgcttcaacctgaacagcgtgctgtgcggcgccgaaggttcgctcggcttcgttgtcgaggcgaaactcaacgtgctgccgatcccgaagtattcggtgctggtcaacgtgcgctacgcgggtttcatggatgcgctgcgcgacgcgcgcgccctgctcgcgcacgagccgctgtcgatcgagacggtcgactcgaaggtgctgatgctcgcgatgaaggacttcgtgtggagcagcgtcgccgagtattttccgcaggacgacgcgcgtccgacgctcggcatcaacctgatcgaattcagcggcgacgacgcggacgacgtcgacgcacgcgtgcgtgcattcgtcgagcatctgcgcaccgataccggcgtggagcgcctgggccacacgctcgcggccggcgacgacgcagtgaagcgcgtgtatgcgatgcgcaagcgcgcggtcggcctgctcggcaacgtgcagggcgaggcccgcccgcagccgtttgtcgaggacaccgcggtgccgcccgagaacctcgccgcgtacatcgccgaattccgcgcgctgctcgacggccacgggctgcagtacgggatgttcggccacgtcgacgcgggcgtgctgcacgtgcgcccggcgctcgacatgaaggacccgaagcaggcggcgctggtgcggcccgtgtcggatgcggtggccgagctcacgcagcgccacggcggcctgctgtggggcgagcacggcaagggcgtgcgctccgaatatgcgccggcgttcttcggcgagctgtatccgtcgctgcagcagctgaaggccgcgttcgatccgcacaaccagttcaacccgggcaagatcgcgacgccgccggatcacacgatgcggctgctgaagatcgacgaagtgccgacgcgcggcgaccacgaccggcagatcgacgagcgcgtgtggcagagctacggcacggcgatgcactgcaacggcaacggcgcgtgctacaacttcgatccggacgacgcgatgtgcccgtcgtggaaggcgacgcgcgaacgcgtgcagtcgccgaaggggcgtgcgtcgctgatgcgcgaatggctgcgcctgcaagggcaggccggcgtcgacgtcgtcgcggcggcgcgcgcacggcagccgttcctgcgcggcctggccgggcgctggcgcaacagccgcgcggcgcgcaacggcgaggccgatttctcgcacgaggtgtacgacgcgatggccggctgcctcgcgtgcaaatcgtgcgccgggcagtgcccggtcaaggtcaacgtgcccgaattccgctcgcggtttctcgagctgtatcaccagcgctacctgcggccggtacgcgactacctgatcggctcgctcgaattcacgatgccgtggatggcgcgcgtgcccgcgctgtacaacgggctgatgcgcgccggttgggtgcgcacgctgctcgagcggcacgtcggcatggtcgacagcccgctcctgagccgcttcgatctcgcggccgtgatccgcgaatggcgcgtgaagccggccgacccgcgggcgctcgccgcgctgagcgacgcgcagcgcgcacgcagcgtcgtcatcgtgcaggacacgttcacacgctatttcgataccgagcagctggcgacgctgatcgagctggcggcgcgctcgggttttcaggtgtggctcgcgccgctcgcgccgaacggcaaggcgctgcacgtgcaaggcttcttgcgcgcgttcgagaaggcggcgatccgcaatgccgggcaactggcggcgctggcgcgctcgggtgtcgcgctggtcggcctcgatccggcgatgacgctcacgtatcggcaggaatacctgaaggtgacggggctcgccgatgtgccgaaggtggcgctgccgcaggaatggttgctgcaggcgctgccggaagcggatgcgggcggcgtgccgcgcgtcgccggttcgtaccggttgctgccgcactgcaccgagaagaccaatgcgcccgacagcggcaagcaatgggcacaggtgtttgcacgacgcgggctgcgtttgcaggtgcaggcaaccgggtgctgcgggatgtcgggcacctacgggcacgaagcgcgcaatctcgagacgtcgaagacgatctatgcgcagtcgtgggcggcgcacgtcgatgcggcggatgtagaaggcgaggcgctggcgaccggctattcatgccgcagccaggtgaagcggatgtcttcgaagcaggtgcgccatccgttgcaggcgctgctcgatcacgtgcgggcggcgggaggatgatcgggcgtcgcatggcgcggtgcccgtgagacgacttccgttccggcggcaagcggcaagcgttgagccgctgtcgacgcatgcctgcgctcaggcgtcggtcttcgtcgtttttctggagcgcggcttgtccgccgcaggaaatacgccgccgccgcgcggccgtttcggttcgatccgcatctgccggatcacgcgccggaaatcgatctcgtgcgcggccagcgtgccgatcagtttcgcgatgaccgcgaggtgggacgggacggtgcccttgctcgaatagttcgtgatcgaactttcgttcatccggatcaggcgggcgaactcgcgcgccgtcaactgtgccttcctcaactcctgttggaattccgcatacgccattgcgcacatgatgcttcgtctccgtgaatcagaaatcggcccgcgcggcgccggcgccgacgggtggcgttcccgtcgtgccggcgccgcggcgggttacatcttcacctggtcgaggaaggttttcttgccgctcttgtagccgtagatcgagatgatcccgtgcgtcaggtcgcccttcgcatcgaaggtcgtcgtgccgatcacgccgtcgtacttcgtcgccggcatcgccgcgaggatcttcgccgggtcggtcgagttcgcgcgcttcatcgcgtccacagcgatgtagaccgcgtcatacgcgaacggcgcatcgaacttgatgccctggttgaagcgcttctggtacttcgcgaggaagtccgcgccgccgggcatcttctcgagcgcggcgcctgcctgcgagcacagcacgttgtcggccgccgggccggccagttcggccagcgagtcggtgcacacgccgtcgcccgacaggatcttcgcgcgcaggccgagctgcttcgcctgcttcgcgagcgggccgccggtggcgtccatgccgccgtacatgatcgcgtccgggttctcgcccttgaccttcgtcaggatcgcgcggaagtcgacggccttgtcgttggtcgcgtcgtgcgacagcaccttcaggccgagcgccttcgccttcttctcgaactcgttcgcgaggccctggccgtacgcggtcgaatcgtcgatcaccgcgacgctcttcacgcccttcgcctgcgcgtagctcgcgagcgccgggccttgctgcgcatcggtcgcgaccacgcggtacgtcgtcttgaagccttgctgcgtgtaggtcgggttcgtggccgacggcgagatctgcacgatgcccgcgtcgctgtagatcttcgacgccgggatcgacgtgcccgagttcaggtggccgatcacggcgacgaccttgtcgtcgacgagcttctgcgcaacctgcgtggcctggcgcgggtcggccgcgtcatcctgcgcatcgagttgcagcgtgatcttcttgccgccgatcgtcaggccctttgcgttgatttcctcgaccgcgaggcgcgcgccgttctcgttgtccttgccgaggtgcgagatgccacccgtcgtcggttcgacgctgccgatcttgacgacctggtcggccatcgcgcccgacgcggccgcgaatgcggcggcagccagtgcgacggtgatcaggggtttgcagcgcatgccgacagtgcttcgttccatctgccatctccgatttgaatgatctttctattggacgtctcgaccgtccgacggcgaggccggggcgatcggatgagtctccatacccgtcatgggtttcacttgcatcgtgtcctgcccgtcggcgtgatgcccggatgagcggcccggggcctgacaacgcgcaattcgtatgaatatatatgaagccgattttgcgcgctgcagcgaatcgcgtcacggggccggtgcggcaaggccggcgcccgaaatccgaaggcgccggatgccggaaatcgtacgccgcggcacgcgatggattgcgattcgctgtcgacggccttacggccgcatccattattcggccggcggccggggcgaagccatggacactgatgcgcggtcaatccggaactgttcggtcgatttgtctgcacagtttggaacgttgtggttgcgcgtccggttgagctgccgggtttcatcgggatcgatgcccctattgatgcaactaacggtcaagccccggcggcgctggcgaactggcgcgagtcgatagcccgcgccatccgatcggctttgcagatgtcggggttcatccgaccggctcgcttgcggatcgtcgggccgactgtgccggcccgatgcggcgttgcgcctaagcgcgtccgcgcaacgccacgaagatcacgccggcgatcgccagcaggccgccgcacaccgtctcgatcccgggccgctcgcccgtcagcgccatcgacagggccgtcgcgaccgccggcgtcagatagaggaagttggcggcgcgtgccgcgccgaagtagccgagtgcgaaggtccaggtcgcgtaacccagcgcggccgggaagatgccgagcatcaggacggccagcgtcgtgtcgcgcgatccgctctccagcgccccgagcgcgccgggcagccacggcgtgagcagcagcgcgccggccagcagcgtgtaagcggtgcaggccagcgcgccgtataccggaatcagccgccgctgcagcacgaaatagctggccgaacacagggccgcgccgagaatcagcgtgctgcccgcgccgaggacgaggccgcccggttgcccgcgcgcgattaccgcgatgccggcgaggctgacgagcgagccgagccagccccagcgattgaagcgctcgccgagaaacacggcggccagcagggccgtgaagatcggcagggtgttcacgatgaagctcgccgcgccggccgacacggtttgctcgccggtattgagcagcgcgttgtacagcgcgatgccgagaaagccgcacagcaggaagcgcagcgcatcgctccgggtcggcacgcgcggccgccgcgccaccagccacgcgacgatcagcacggccgcggtggcgaagcgtgccgccgcgagctgaagcggggtcaggccatgcaggccgatccggatgaacgggaaagcggacgcccacgaaacgatcgtgaaggcgaccgcgccggccgcgaccagcggctgccgcgcagcgcgcgacgacggtgtggagagagtgttcatgcggcgatgatgcggcgtcgcgagatgttaagctagcgcacagatcagcatccggatatgacgatgattcacagctcgagccggcggccggtcggcgcttcaccccgcgcgaagcgtggcgcgccggcgttgcccgccgcggcgccgacgccggcgccgggttcgcggccgccgctcgcgagcctggagacggtgtgcacggtcgcgcgcgagggttcgttcctggccgccgccgacgtctccggcgtgacgcacggcgcgatcagccggcgggtggccgccgttgaaaactggctcggcctgaagttgttcgaacgtcatgcgcgcggcgtgcgcctgacgccggacgggcagcgcttcgtcggccggatcgaacaggcgttcgcgatcatcgacagtgcggccgatcagtggcgttcgccgcgtgcgccgcgactggtcaggatgagcgtggtgccggcattcgcgcagctgtggctgttcgagcggcagcatgcgctcgagcgaggcgcccgcgttgcagatcgaactcggcatcgatcttcgcaacgtggatatcgccggcggcgaagcggacctgtcggtccggtacgggcgcggcaactggcgccagctcgaaacccgtgcgttcatgccggagcggctctatccggtcgcgcatccgcggctcgccgcgcaactggctgcggaacgccgccggcgcggcgatgccgcgttgctcgacatgccgttgctgcacgattccgatgtgaccggctggcgcacgtggttcgatgccctgggcgtgccgttcaagccgcgcgcgcaggatcgccggttcgaggattacaacctcgtgctggccgcggccgaggccgggctcggggtggcgctggcgcgcgtaccgcttgccgacgcctatctcaagcgcagcgaactcgtgcgcgtgagccgccgcgaggtcgattcggtgctccggtattacttcgtgcacgcgaaggggagaatcggccggaggtgctggcgttgatggagcggatgcgggcggcggtggcggcaggcaactgatcgaaatggaaatggtcgtggcgacccgccacggcgggccggctgctgcgaaggacgcggtgcgcgattcgaggcactaggccggcggcgccggatcgacgacaatgcgtccgcgaaaaacgatgaggtggagagatgaacgaaaatcgaaaatgtatgcatccgtgcgggtgcaagcgaggtcaacaatgaacaggccggacaaatcgtcgaaagcgcgtgcagcgctcgaccagctgttttcgggcatggcgcccacggacgagacgcgcgcgtcgcgtcccggcaatccgttcgaagcgaacgcaaacgaggcatccgccggcaccggcgtgcgcggcgggatcgaagtcacgctgtcgacccggattcagctgcgcggttatccgaatgcggacgcattcatgaagcgcatggccgaagcgtgggggctggattggggatgtacgacagcgtcaaggccatcgcgacgctgcccgccggatggcgagcgcgccggcttccggaagtcacgcagatcgtcgacgggcacgacgtgctgcgcgcggagagcagcctgcagggcggcgagatgtcgtacctgaaagtgcatccgcggtactacatcgacgcacgcaaggggttcggctggggcaagtcgtcgaaggcgtccgacgatccggatctcgacggccccgactggaactgcttcgtggtcgatcgcgagaagtccgtcgaagtgcatgaattgacgacctcgtcgctgaaagccgacatggacaacgcacgggcgacgttgctgaaatggctggacgaaaactatccgaagcatcgcgatccgttcgcttactggacggattgcgaacgggcgtcgtgatgtggcttggctgcccggttcggcatcgcgggcacatgctgcccgaccggcgccggagcgggggcggcacacgctgcttcgattcctcggccggttgcgccggggcgccaattgaaacgcgccagtgtcgtcccgattctctgggcggcattcgccgcggcggtcggctcgaccgtcgtcgagctgctgctctggccgatcgccggcgatgatgcgatcgggaacctgctgcgcgacgcacgccttacggccgccatcgtgatggggcgacgcgtgctcgacgcgtccgccggcttcgatccgctggtcatggcggtggcgaccctcgtgcatatggtgctgtcgctggtctatgcggccgtgctggtgaaaacgatccgcaccctgtcgttcgcggccgcgctactcgcaggcggcgcgttcggcctcatcctgtacggcgtcaacctgtacgccttcacagcgatcttcccgtggttcgttccggttcgtggtgcgatcacgctggtggcccatctggtattcgggatcagcgcggcggcggcctaccgcttcgcgaggcgctaggccggcgccagccgccagccgcggcatcgactgtcgaaggttcccgcgttgatcaatcgcaccagacccctggaataagcaggcgcgccgcatcgtttagccggcaggagaccctgtacgtagcggcggcgcgttaccgccgcgtggtgaatcgtgcgtgagcgattcgatgtgtcgggcaccgccaacggtgcccgcgatctagcggtcgggggcaatcaggagccgatcatgggcaacttgtttcgagccgggataggtatcgtctgtctcggctgttccgcggcggtcttcgcgcaaacgtacgacgatctggcgggcgacacggccaactgccgtgcagtcgtcgcgcgagcgaacatcgacggcacggaccagcaaatcgtcgggcgtgcgtgcctgcaggacgacggcacatggcagttcgtgcagagtcccgatggtagtgttttatggtatccggcggtggactacccgtatgccgacctggggtactgggggccgccgcttttcatcggcgcgggcgtgggcttcgtcttcatcgatcgtttccaccacttccaccgtttccaccatttcgatccggtcgttcacgtcaacgggatggaacatcgccgcttcggcgtgccgatcggtgccggttttcaccatggcgcgttcccggtcggcgcgcatcgcgaattcggcggaatgcatgggttcggcggcatgggcggggcgggggcatgcggcgacattaggctcgcatttccggcttgatcgtgcgccttcttccagctgcgtcaggcatgggggcgcttacaggatcgacgcgagtctcggcacccggagcaggacgccggcaatcaggtagcacgtgacgcaagcgacaccgccggtcacggcgaatttcaggaacggcgacaccggcacggttcgccacacgagggcgatacccaccagcaccggggatggatgatgtagatcgtgtacgcgcgccgggacagcgaccgccatgcgcccgtcagtcgatcgaagcgccgctggaaacggctggcaagaaacaggctcgttccccacgcgaccagcggctcccagaatgcgtagatcacctcctgcgggtggccgcgcaatgcaggaacgtgcttggcgagcaggtaagcgaccggcaggacagggagtgccagcagtgcgatgcgccaccacagtctgacctgccgtgccggcagatgctcgatccagtgcacgcgcgcggtccggcacccggctgcgtacaacacgacgtagctcgcgaagtagccgagctgcagccccatacgttgatacctaccggccatcgggaccgcaacgccagtgccgcgatacccgtgagcaacgccgcggcggccaacgtcctgtcggacggaaaggggttccggtcggggcggttcgtatcgcgcgccacggtgcgccggaaggcgatgtgccagagtgctgcagctgcgctgaacatcagcagcgcctcggcgaaccacatcgggccgttctcgaacgtgcctttccgccacaggcggcccagcgtatccgcgaacgggtggtctccgcccgattgcgccagggcgatcgttgccgggccgatcacgaagccgtacaccagcagaggcaggccgagcctgatgaaccggtcggcgaggaaacgggcggcgccctttcgatcgatggatggcgacgtgtaatagccggccaggaaaagaacaggcccatgaaaaggcctgattgatcgcgcagaagagcgtcagcagtgcggattccacggacggcccggcagccacctcgtggtagtaccacccgccgagcgcgccgtatgtgatcgcgcagtggtgaaagaccaccagcaacgtcaggcacgcgcgcaacgcgtcgaggccggcgtttcgatggacggctgccgccgtgtcctgccgagaagcgaagtcgaccgggacgtcctgagcgctcatcacgttgcctgcgtggttggtcagcgatgacccgcctggcgacgatcctggtcgcgacgacgcatgcgaatccggcgggcgtacaggtcggcaccctacaccgttgttcttacaaccatccaacaagccgccccgccgttggcgcggcgcccgctcagtcgagcttgccgcgcaggtcgtcgaacggaatcatcacgtgcgtgcgatacgcgggccgcgctttcagccgttcgtaccacgcctgcacgtgcggcaggtccggccgggcgatgtcgagctcgaaatagcgatacagatgcgtgccggccgcgatgtcggcgagcgtgagcgtgtcgcccgcgagaaacggttgcccggccagcaccgcatcgagcgtccggaagtattgcgcgcactgcgcgatgctttgctcgacgcgcgccgtgtcgcgctgctcgggcggcgtccggtagaagcccggaacacgccgttcaggaacgtcggttgcagcgtggtttgcgaccagtccatccagcggtcggcgcgcgactgttcggccggatcgtcgtgccagaaaccggggcgcccgtaacgcgcggcgaggtagcgcaggatgctgtgcgattcccagacgaccgtgccgccgtcgtcgatcacgggcacgcgcccgtgcgggttcatcgcgagaaaaccgggcgtgtcgagcacgccgaactgcccgccggccggcacgtgccgatgctcaagcgcgagctcgtcgacgagccacatcaccttctggacgttgaatgcattgcgacgcccccatacggtcagcatgccggcctccttgtgtcgtgcggaacttgaacgcggacagtgtaaacgccgcaggcgcgcaccgcggtgcgcgcctgccggctgtcgtccgtcgctgtcgtcgcctggcggcgacgcgatcagaacttgtggcgaatcccgacgatcgcgagttcctgcgtatcggtgccggagttcacgccgtacgagccgaccgacgcggcggccttcacgaccgcgccgttcgcgttgagcgtgttgccgctcgccttctggtagccgaacagcgcatacaggtcggtgcgcttcgacagcgcgtagtccgcgccgaggttgacctggttgtagtgcgcggaagacgggcccgtcagcgacgtgtagttgtagccgacacccgcgcgcagcgccggcgagaactgccagttgaagaacgcggagccgttgttgaacttcgcgttctggctgaacgccgacagcgtgtccgcgccgtactgcgtattcgaatacgcgaggccgaaggtagcgggcccggccacgtaatggccggccacacgcacgatctggatcgacttcgcgctcgagaagccctggttgatcacggtgttgaacagcgtgtccgagctgctcgaccacgtgcgcacgccgttcgcgaccgaggagccgccgttcgcgtagaagaagccggcgccgagcgacagcgggccgttcgcgtagcttgcgccgaagctgtacgtgcggccgctgccggtggcgcccgcgacgccgccgaagccgtacaggccctcgaactggaagcccgagatcagcgggctcgtgtatttcaccgagttgctgacgcgcaggctgttgtcgtagttgtcgaggtcgcccggcgtcgcgaacacgccgccgaagtagttgtcctgcgtgaggccctgcacgaggtcgacgaccggatcgtactggcggccgagcgtgacggtaccgtacgtgctgcttgcgaggccgacgacggccttgcggccgaattcgcgtccaccctggccgagtgcgcccgtgccgatgttgaagccgttctcgagctggaacagcgcggccaggccgccgccgagatcctcggtgccgcgcagccccagcggctgccggacaggttgccgctgctgaacttgacgaggctcgacgcgttgctgccgttcgcgttctgcgcgttgtggacataggcgatgcccgcatcggcgatgccgtacagcgtgacgctgctttgcgcgtgggcgccggcggcgaagagcgcggccggcagcgcgagcagtgcgaatgaacggaccggtttcattgttggattccccagttggtcgattggtctgacgagtcggtgaacgatacggacagcgcatcgtcgagggaaccaataaattgtcggatcgttatgaggcggcgcggagatggatgcgcgcgcaaccgaccggcgggcggtgcatggggacgttatgcgtcataccctggatgaacgatgcgcacatgtgcatcgcgcgcgctgcatcgcgacgtcggctgcagggcgttcactgtgcgcgcgatcctgcgcgcgggtcagtggtgttggttgccggctccgaacaggcgaggctgcgcggcgttcaacgcgtcgtccgcttccggctgccacgggaaaaccccgtcgcggtcgggccacagcaactggacgcacgggaacgcgtcgttgccgtagaaccagcggttccagccgagatgggcttcgtagtgcgccttctcgaccggcatcagcagcgcgttcgcgttgccgaagacggaatccgtgacctcgccgaccggcggcggcgtgccggccgcgaccatccggtagacgtcccacagcacgtcatggacgatgcgcgccggcatcgagaacacgatgagttccggaaaaccgtggttgacccacagcccggtcgtgaaagaaaacccgggtgcgtccccttccgcgaacacttccgtgcggaaccacccgtgctgacgaatccgctgcacgaatcgctgctcgtcttcctcgagcaccgaatcgggcgcgtcgagcgcggtggcgatatccggtcgcgtggtcatgcggggctccttggatctgcgtcgggcgacgggaagccgggggcggcatcccgccggcgggaatgcgaccgtggccgaaccggccggcgatcgccgtgcgccatgttgccacagcggtcccgcctactgctccgccttctccacctccgccgtttcgccgaggaacccgccgctctggtgcgcccacagcgccgcatagatgccgccggcctgcagcagttgctggtgcgtgccttcctcgacgatgcgcccttcgtcgagcacgatcagccggtccatcgccgcgatagtcgacagccggtgcgcgatcgcgatcaccgtcttgccgctcatcaggccgtcgaggctgcgctggatcgcgacttcgacctcggaatcgagcgcgctggtcgcttcgtcgagcacgaggatcggcgcgtccttgagcatcacgcgcgcgatcgcgacgcgctgccgctggccgcccgacagcttcacgccgcgttcgcccacctcgacgtcgtagccgctgcggccgtggcggtcgcgcagtcggtcgatgaattcggacgcctccgcgcgcacggccgcatcgtgcatctcgcgctcggtcgcgtcggggcgcccgtacaggatgttctcgcgcatcgtccggtgcagcagcgacgtatcctgcgtgaccatcccgatcgcgccgcgcaggctgtcctgcgtgacgtgcgcgatgtcctgcccgtcgatccggatcgtgccgccgcccacgtcgtagaagcgcagcagcaggttcacgagcgtcgacttgccggcacccgagcggccgatcaggccgatccgctcgccgggccggatcgtcaggttcaacccgtcgaacacggcacggtcgttgtcctcgtgcgcgaactgcacgttgtcgaacacgatcccgccgcgctgcaccgcgagcggcttcgcatcgggcgcgtcgaccacgctgcgcaccttcgtcagcgtattgatgccgtcctggatcgtgccgacgttctcgaacagctcggtcatttcccacatgatccagtgcgaataactcgacaggcgcagcgccatcgcgatcaccgccgcgacgacgcccgcgctcgcctcgccgtgcatccacagatacagcgcgaggccggtcgagccgaccagcagcagcgtcgacagcaggtgattgacgatctcgaacgcgctgacgaggcgcatctgcgcgtcgccggtcgccttgaacgcttccatcgcgcgccgcgcgtggtcggcttcccgccgcgtgtgcgagaacagcttcacggtcgtgatgttcgaatacgcgtcggtgatgcggcccgtcatcagcgcgcgcgcatcggcctggcggctgccgacggcgcccaggcgcggcacgaagaacgcgcatgccgcgccgtagccgagcgcccacagcgcgagcgggatcatcagccgccagtcgaagctggccgcgagcgcgaggatgccgatcaggtacgcggcgacgccgatcacgacgtcgaccgacatgaacagcgcatcgcgcaccgcgagcgcggtctgcatgatcttggtcgtcacgcggcccgcgaattcgttcgcgtagaacgacaggctctggtcgagcatcagccggtgaaacagccagcgcagccgcatcgggaagttgatcgcgagcacctggtgcttgaccatcgtatgcagcgcgatcagcaatgcgctgccggcgaggattgccgcgaaagcggtgagcgtgccgaagtgccggccgccgaaatccgccggcgtcgtggacgcgagccagtcgaccacgcgacccatcatcgcaaacagcgcggcttcgtacgcggccagcgcggccgacgtgagcgcgatcagcaggatccagctgcgcgcgcctttcgtgcacgcccagacgaacgagaagaatcccttcggcggcgtgacgggatcttcgagcgggaaagtcggcaggcgccgttcaaaccacgaaaacattgaaacctctcttgatgcggccacgcctgcgggcgcggccgtattgcctgtttcaggtgcggcgccttcgcggcgccgcggtactgcacacgtgttcactgcgaccggatccacgcctcgatcggggcgagcgtgcccggcgcatacgcatggcggccgagcgccatgtacagccatgtcttccacgtcggccagtcggactcgagctggtagtcgaaccagccggcgcgcagcaacccatgcgtcgcaccgggcatgaccaccacgcgccggtcgggccggtccgcgaaggcatgcgtgtaggcagtcgcctcgtcgaccggatcgacattgcgatcctgcgcgccccacacggccagcacgggcccctgcatcgtcgcgagcgcctgcgacgaatcctccaggtagttgcgtgcgatgaagccgaagcggcgcggctcgatgtcggggcgccgctgcggatcggcgggtacgtccgtccggccgaagatttcgtcgttgtcgcgtcgctcggcggccagtgtcgcatcgattcgatccggctgcaggcccgttgcctggagctgctgccgcgtcaggtaggtgccttgccggcgccagccgacggcgccgccgacgatcaccgagaacgccggtcgcaccgcattcgcgacgcgcggcacgacccagccgccttgcgagaagccgagcaggccgatcttgtgcgcggggccgacgacggcgcgcacgcgcgccatcgcggcgagcgtttcgttcgcacgatcctgcatcgattgcgcgagccagtcgccgccgctgcggccggtgccctgcttgtcccatgcgaacacgccgatgccggcgtcgagcaggctgttgacgagcggcagcatcgcgtcgtcggagaagcgggtgcgcggcccgtcaccgtgcacgagcagtacgatcggcgcgccgggcgcatgggccggcagcgcgagcgtgccgacgaggccggcgccgttggcgcggaacgtgagcgacgacacgttcgcgcccttcagctcgaagtcggcgaggccgcgcagcacgagcgcaccggccgcgacgagcacgaacaggacgagcgcgatgccggcaatgacgattcgtttcaagaggccctcggtacggtggcgtgagcggatgccgcaggcggcatgtgcgggggcacgctgccttgacgcctgcaggacgtcgccacgataatagatcgattaatcagtctaataaagattcgagtcatcgtcgagtacggagtgcctgttgagaaagatcgaccctgaaagagtggaagcgaagcggcgccagatcctggatgccgcgatcgactgttttgcgcgcgacggcttccatgcgacgtccacggccgcgatctgcaaggcggctggcatgagccccggcaacctgttccactatttcccgacgaaggcggcgatcatcgaggcagtcgcgcaggacgaccagcgcgagatggccgaactgttcgcgcggtacgcggacgccgacgacgcgctggccgcgatcgagcagatcgcactgacgttgatggaactgtcgagcgatcccgtctatgcgcgcatctgcgtcgagaccgcggcggaggcgacgcgcaatccggacgtcgccgcgctgttcgcggcgaacgaggcgcaggtgaaagggcggatggtcgcgctgatcaagcgcggtgtggcgcaagggaagatcgacgcaagcctgaagcccgatcttgtcgcgacgtggctgctcgcgctcgcggaaggcgcggtcgggcgcgtggtgttcgagccggggttcaagccgcgcgcgcaccgggcgatgttgcggacgatcattcagcggatgttgaagccgcagtaaggatcgcggatccggtttgacgcccgcccggttcgggcgcaatgcgccgcaccgaaccggatgcgggcatcccgcggccattggccggcgagcgcggacaaggcgttcggtgcactacgcattgcgcccttaaaaagttcttgactgtctatctatgagtagataaagttcgctccatggaaacgaaaccgaccgtccgcgaacagattctcgaccatgcgaccacgctgatgatgctgcgcggttacaacggcttcagctatcgagacctgtccgacctggtgggcgtgaagacgtcgagcatccactactacttcccgtcgaaggacgacctcgtgctggaagcggtggcggcatatagcgacgaagtcctctcggccatgcgggcgatcgatccggcgttgccggccgacgtgaagctgagcctgtacacgaagatgttcggccggacgctcggcgacggcaacctgatctgcctgtgcgggatgctcgcggccgacatcgaaacgttgccggagaatgtgcggcaggcggtgcaggcgttcttcaaggccaacgagagctggctggcggaattgttgaagcagggcgcgcgggaaggcacgctgcagttcagcggcgagcccgagacggccgcgcgcacgttgtacgcggcgttccagggcagcgtgctggccagccggctgtttcacacgcgggcgcgcctcgaagatgtcgaggccgtctggaaaaagcggtcctgacggagcgcgcatgcagtgaggcggttcgccgcctttttattgaatctcgctgtctatctataagtagatagagttctggcgcagatggctcgaccatctgcatttttggggatgtttatctatctatgagtagataaacaggcgcgatgcgggcagcaaggctgtcggcacgcggtccccggttcgaaggctgtttcattcatttgctgaaaaggagtctgtcatgtcgatcgaaaaagtgctgtaccgcgcccatgcaaagccaccggcggccgtgacggccgtgccacggtgcccgagagcaacctcgacctgaaactgaccacgccgcgcgagctcggcggcgcgggcggcgcaggcgcgaaccccgagcaactgttcgctgccggctacagcgcgtgcttcatcggcgcgatgaagttcgtcgcggcccgcgacaagatcgcgatgcccgcggacgcttccatcgaaggcagcgtcggcatcggcgcgatcccgaacggcttcggcattgaagtcgagctgacgatctcgctgccgggcctcgatcgcgacatcgcgcaaacgctgatcgaccgcgcgcacgtcgtgtgcccgtattcgaacgcgacgcgcggcaacatcgacgtcacgctcacgcttgcctgatcggtcgcactgcgaatcatccatcgtcatttacgcctgaagccaaggaacaccatcatgaaaatcgtcaagccgctgctgatcgctgccgccgtcgccgctgtactgtccgcctcgaccacggcattcgccgccggtgccgataccgtccgccccgatacgacgacgagcgctttcctcgccgcgctgaacggccagaagggcccgggcctcgaaacgctgagccccgcgaaggcgcgccaggtgctggtcgacgcgcagaacggcacgaaggtcgacctgtcggggatcgacgtgtcgaaccgcacgatcgaacaggacggcttgtccgtaccggtcacgatcgttcgcccgcaaggcgcgacgggcacgctgccggtgttcgtgttcatccacggcggcggctgggtgctcggcgattttccgacgcatgaacgcctcgttcgcgatctcgtcgtgcaatcgggggccgtcgcggtgttcgtgaactacacgccgtcgccggaagcgcattacccggtcgcgatcaaccaggcgtatgcggcgacgaagtgggtggccgcgcacggcgcggagatcggcgtcgacggcagccgcctcgcggtggtcggcaacagcgttggcgggaacatggcggccgtggtggcgctgatggcgaaggacaagggtggccccgcgatccgcttccaggggctgatgtggccggtcacggaccacaacttcaacacgggttcgtacaacgcgtatcagcaagggcacttcctgacgcggccgatgatgaagtggttctgggatgcctatacgaagaacgaagcgcaacgcaacgagatctacgcgtcgccgctgcgcgcaagcaccgcgcagttgaagggcctgccgcccgcgctgatccaggtcgcgcagttcgacgtgctgcgtgacgagggcgaggcgtacggccgcaagctcgacgcggccggcgtcgatgcgacgaccacgcgctacgacggcacgatccacgatttcggtttgctgaacgcgctggccggcgacgcgccgacgaaggccgcgacgaaggcgatggcgaatgaactcgcgacgcggctgaagtaagcgacgggttcgcgctcgcgctgcccgtgaggcgaggcagcgcgagtgcgcatgacgacgaggcgggcgcatacccgcctttgttgcgtgcggcgcgtgaaccgggcgaatgtgccggcctgcaacccgcacgcccccatcgcctgcgatttttcgtcccggttcggcagctcgagctccgtcgcgaatcgcgccgcatcgtcggcttcgcgtggtgcttcacggcgtgcccgtgaccacccgcatcgttggccccggcgcccgctaagcccgggccgcgggcattgttggtacgatcgcgcgtatcgtccacgccggcgccgcaagccgccggccatcggtcgcgcggccgtacggcagcgcggccccgttcgggagaagcgtttcatgctgcaggcgttcgcggtcttgctgaccttccagtgtctcgggaaggcgtgtcctacctgttcggcctgccggtgccgggccccgtgatcggcatgctgctgctgttcggcttcgtgatgctgcgcccgcaggtggccgacacgatcgagccgaccgcgctcgagctgttgcgccacctgtcgctgctgttcgtgccggccggcgtcggcatcatggtgtcggccgatcgcgtgcgcggcgatgcgctcgcggtcgtcgtcgcgctggccgtcagcaccacgctcgcgatcgccgtgacggcgctcgtgacgcgtgcactgctgcggcgccagcggcgcgcgggcgatgcggtggagggcacgcaatgacggccttcccgaaactcggcgcgatctgggtctatctcgccgcgagcccgctgctgggcctgaccatcacgctgatcgcgtatctgttcgcgcaggccgtctatgcgcgggcgcgcttcaacccgctcgcgaacccggtgctgatcgcggttgcgctgatcgtcgtgctgctgacgatcacgcacacgccgtacccgacgtatttcgaaggtgcgcagttcgtccacttcctgctcggccccgcgaccgtcgcgctcgcgctgccgctgtaccgccagtggtcgaagctgcgccgcgccgcggtgccgctgctggtcggcctgctcgcgggctcgctgaccgcgatcgtgtcggcggtcggcatcgcggcattgttcggggcgtcgcaccagacgatcgcgtcgctcgcgccaaaatcggcgacgacgccgatcgcgatggccgtcgcggcggaaatcggcgggattccgtcgctcaccgcggtgctcgtgatctcgaccgggatcttcggggccgtgtgcgcgcgcggaatcctcaacgcactgcgcgtcgacgaaccggccgtgcgcgggttcgcgctcggcgtcgcgtcgcacgggatcggcaccgcgcgcgcgttccaggtcagcgaggaggccggcgcgttcgccgggctcgggatgggattgaacggcgtgctcaccgccttcgtcgtgccggtcctgctgccggtgctgtcgcgctggatctgagcgccggccgggccaggccgggttatcggtttccctgatggcgcgggcgacgcgccggaacgacggcgtacgcggtgcccacgtatcgttgccgttatcgggagaattcaggaacgcacaaggacaagtacatactgttcggctaacgttgcatcggcgccgttgtcgcaagcggtcgtgtgcgcgccggtgttctatccacaatcaacaatcgacaaggaggtccggccatgaagaagtctcgcgtggtttcggtggcagtggcagtaacggcgtcgttcggtctgctgttggcagccgcgccggcggcatatgcgcaggatccggcgtccgcgccgacgcagaagcagatcgacaaggcgcagaagaaggcggcccgcaaggccgcccgggcgcgtcacgcgtcggacctgaaggcgatcggcacgggcagcggttaccggctgaccaacgaccagagcaactacccgcagaacgccgcgcagaaggcgcctgcgacgaaggcggcgcccgccgctccggcgtcgggccagtaacggccgagcctgggctgcgcacacggcgccgggtcgaccggcgccgtgtgcgcgtgtgcggccgcgaaggcggcctgttacgacgcgagcttgctggcgagttccgcgacgtgcttgccttgatagcgcgcgatgtcgagctcgttcgcgctcggctggcggctgccgtccgcgcccgcgagcgtggtggcgccgtacggcgtgccgccggtgatttcgttcatgttgacgaggccgctgcacgcatacggcacgcccacgatcaccatcccgtggtgcaggagcgtcgtgtggaacgacgtgatcgtcgtttcctggccgccgtgctgcgtgccggtcgacgcgaacacgctgccgatcttgccgacgagcgcgcccttcatccacaggccgccggtctggtcgaggaacgtgcgcatctggccggccatgttgccgaagcgggtcggcgtgccgaagatgatcgcatcgtagccggggagttcgtccacggtcgcgaccggcgcagcctggtcgaccttcacgccgatcgcccgggcctggtcgacgggaatcgtttccggcacgcgcttgagcgtgacctcgacgccgggcaccgacttcgcgccttccgcgatgtgctgcgccatcgtttcgacgtgcccgtaggacgagtaataaagaacgagtaccttggccatgttgcgaatctccgattaaagggccccgcgttcagcggggccggtttcccgaacgggctttatgcccactcggccgttacttcgaccggacgcaggtcgaacaccagcacttcggcatccttcccgtcggcgaatgtcagcgtccgttcgtcgcggatgcgcacgccgtcgccttcgccgagcgtcacgccgttgaccgacacgctgccgcgtgccacgtgcacgtacgcaaagcggtccggcgccagttccagcgtcgcgcgttcggcgccgtcgaacaagcccgcgtaaatccgcgtgtcctgccggatcttcagcgaaccggcgtcgccgtccggcgatacgacgagggcgagcttgccgcgcttgtcgtctgcggtgacattcgtctgctgatagcgcggctcggcacccttctcggccggccccacccagatctgcaggaagtggaccggcagttccggcgagtggttgaactcgctgtggcgcacgcccgtgcccgcgctcatcagctgcacgtcgcccggcacgatcaccgagccggtacccatcgagtccttgtgttccagcgcgccgtcgagcacgtacgacaggatctccatgtcgcggtgcgggtgcgtgccgaagccgcggcccggcgcgacgcggtcgtcattgatcaccagcaggtcggagaagccgacttgcttcggatcgtagtaattcgcgaacgaaaacgaatgacgggagctgagccagccatgctccgcacggccacgttggtttgctgcacggatttcgatcatgatttttgttcctcaagacgccggacctcggaagtgggaccggccgttcgttgaggtgaatcttaggtcaatcgatttgacaaataaatggctgtagagataatgactgtcgctatggagtggacaatatggaaatcaacgacctgaggatcttcgtcgcgacggtcgatgcgggcagcttcacggcggcggccgatcaactgatgctgtccaagcagttcgtcagccggcgcacgatggcgctggaggcgtcgctcggcgtgcggctgttgcaccggaacacgcgcaacctcgcggtgaccgaatcggggcaggagttctatgcgcgcgcgcagcggatcctcgcggaaatcgccgacgccgagcaggcgatgtcggtgcgcagcaccgagttgcacgggtcgctgaaaatcagcgcgccgctgtcgttcgggatcacgcacgtgtcgccgctgattgccgaattcctgtccgcgcacccggccgtgcggctgaacctcgacctgacggaccggcgcgtcgacctgatcggcgagggcttcgatctcgtgctgcggatcggttcgctcgaggattcgacgttgatcgcccgcccgctgggcgcgtggcggatggtcgcgtgcgcgagccccgcctatctgaagcggcagggcacgccgcagacgccggcggatctcgccggccacacgtgcctgctgtacgggcgcgagcggcgcatcggctgggaattccgcgtcgacggcgcggcgcgcacgttcgacgtgcaggggccgctcgtcgcgaacaacggcgaagtggtgcgcgacgcggcgatcgcggggctcggcatcgcgctgctgccgcacttcatcgtcggcgcggcgctcgacagcggcgcgctcgtgccggtgctcgacgcgtatgcgccttcgccgatcacgctcaacgccgtgttcccgcagcatcgggagggattcgtcacgctgcgcacgttcatcgggtttctcgcggaacggctcggggaggctgcgcccgcggcgaagggcggggcgggtcgggcgcggtagcgggccggtttgcggggaatggaggctttattctccgcatgatttgcggagaatgttgagccatgcggtgaatcggtgggataatctccgcatcatgagcggagattacaccttcatctgggcgtcggccgactggcccgcatggcgcttcgatctgcctgcactggcaacgccactcgccgacgtcagccgtgcgcaaggcatgctggccgggcggctggcggacgtcggcctggcgctgcgcgacgaggccagcctggccgcgctgacggaggacgtcgtcaagaccagcgcgatcgagggcgaaagcctgaacgtggcatcggtgcggtcgtcgatcgcacgtcggctcggggtcgatatcggcgcgctggcgccggtcgaccgtcacgtcgagggcgtcgtcgacatggtgctggacgcgaccacccatgcggcggcgccggtcaccgaagcccgcctgttcgggtggcatgcggcgctgttcccgaccggctattcggggatgtcgcggatcacggtcggtggctggcgcacggatgcgaccgggccgatgcaggtcgtatccgggccgatcggccggcagcgcgtgcatttcgaggcgccgcccgccgcgcgccttgccgacgaaaccgggcgctttctcgcctggctcaatgccgcgccggtcgagcccctgctgatccgggccggcctggcccacctgtggttcgtcacgctccatccgttcgacgacggcaacggccgcatcgcgcgtgcgctcggggatctggtcctggcgcgtgccgaccgcagtccgcaacgcttctacagcctgtcggcgcaaatccagcgcgagcgcaacgcgtattacgacgtgctggagcgtacgcagcgcggttcgctcgatgtcacggaatggctcgcgtggttcctgaccgcgctcggccgggccatcgatcacgcgcatgcgacgctcgacgccgttctggtcaaggcgcgcttctggcaacgatgtgccggcgtcgcgatgaacgaacgtcaggccaaggtcatgaatcgcctgctcgacggcttcgagggaagttgacgagcaccaagtgggcggcgctcgcgaagtgctcgcaggatacggcgctgcgtgacatcactgaactcgtcgagcgcggcgtgctgcaacgctcgtcgtccggcggccggagcacgagctacgaactggtgccgttcgacggctgaccgctgtattgcgtcgacccgcagattcggaaggccggcaggcgccacaacgcgatcacgctgtgcggcctgtgcaagggcaccacgcgagccgcgggctcgattgatcgttgcgtgcgcatcgatcctgtcagtcgatgccgccgcggaagccgcattgcgcgacggcatcgtgcaatgcggcgaggccgccgcgacggttgcgccgacatcgaacgtcgattgatcggcgtcgcgcattcgggttaggcttcggcgagccacggcatgcgctccatgccgggccgggcgtttttacctcgaatgccgcgtgcaggtagcttctacgggcgcgcgatccagcgacgatccaagccgatgatcctccagaaccaatcgaatgctcgcgtgaaaaccgcgatttctgccggccatgcattgcacatgcgcgtgcgatccgtcgcggcggccgcgctgctgacgctgttgccggccgccgcgcacgcggccggcttcgactgcgcgaaggccgcttcgtcaaccgagaagacgatctgcgcggatgccgcgctgtcgaagctcgacggcgacctcgcggcggcgtggaagcaggcgctcgcgaaaggcggcgacacggccgcgctgaaggccgcgcagctgaagtggctcaagcagcgcgaccggtgcggcgccgacgaatcgtgcctcggcgaccgctaccgcgaacggctcgcgagcctgaacggcaggccgctggccgccgatcgctggcagcagacgtggtacatgaagagcgccaacccgtcgttcggtggcgtgctgacgttcaccggcacgccgccgcgactgcatttcgagctggccggcaacaatggcgcgaatacgggcgggctcgacggcgacatcgtgctgcacggcgacgtcggcacctaccgcaaggacaagtgccggctcgagttcgaacggaagggcggacgcgtcggcatcacgcaacacggcgcggattccgactgcggggccggcatgggtgtcttctacggcggcgagtacttgactgcgtcgcagttccaggccgcgccggcggccgacctgctgagcctcgaggtcgtcgccgacccgacgcagaacgcgaccgcgcacaagctgctcggcgccgattaccagacgctcgtcgacaccgccaactacagcaccgacgaaaaggacctcgacgggctgaacgcgcacgtgacgtcgtactgggtgcgcggtatcgcgacgacgaacgccgcgatcgtgatgcgccgcggcaatgatctatggatcgggctgctcgtgttcgacgcgcagagcaacgtccggatgcgctattactcgaacgtgcccgcgtggaagaaaaccgtgccgaagacgatccaggcgtggcacgacaggctcgacaagacgctgccggtcgacgtgatgcagtgacgagcgggccgggcggccgaagccgcccgccacggcttcatttctttcccgctgcgcgcgcgtgcgccggtggcgcagccgatccccgcgtacgcaattcgggcaggacggcatgaccgggccccgtcgcgccgttctcgagcgcatcgagcaaggcctgtgcggcctggcgcccgatcgcgtcggtgtcgacccacatcgtcgtcagcggcggctggatttcgcgcgcgagcgcgacgtcgtcgaacccggtgatcgacaattgcgcgggcacgtcgatgccgagcgcctgcgcctcgagcagcgcgcccagcgcgagcgcgtcgttcccgcagatcacggctgtcggccgcgtcgccgcatcgctgttcgcgatcgcgcgcaggctcgcccgcccgaaggcgatcgtggccgcgccctcgtgctgatggacggggcgcaccgcgagcccgcgcggcgagcgtgtcgtgaatgccgcgcaggcgggcctgcacgcggtcgttgtcggccgacggctgcatgatgatcgcgaaatcgcgatggccgaggtcgagcaggtgggtggtgagccgcgcgaatgccgcgcggttgtcgaagccgatgcagcagtgcgggctgtcgtcgcgatacgcataagtgacgacgtacggcacgcggtgcatcgcaaggagttcgaacagttccggcggatacgcttcgccgaccagcgacacggcctccacgccgcgcgacagcatcgcacgcacctgggccagcgcctgcgcgggatcgtaattcgagcagccgaggaacagcgtgatgccgtgctcggccatgaccgtctgcatgcccgcgacctgcgacgcgaacacctggtcgtcgagtgtcggaatgatcgcgcccgtgatgtgggtgcgcgtggacgcgagcgcgcggcccgccgcattcggaatccagttcagcgcgcgcgccgcgtcgcgcacgcgctgctgcacgtcggccgacaccttgccgggatcgttgtacacacgcgagacggtcgcggtcgatacgccggccagcttcgcgacatcgccgagcaccgagcggccgctgccgcggcgcgcccggggcgcgccggcacgggacggaggcgtgctcatcggccggctcccggcggggcggcagtgacggcgccccgcgttgtcaaatgcgtcattgtttaccctcgattcgtggtggcgccgcttgcattcccgctcgaccctgtgagaatgtaagcgctatcttggcgtgcttccgcattatgtcagacacatattctatccatatcgtgagattttcatcgacgacggccgattcagccattttgtccgccgcaaatgtaagcggttacattgcaaaatgagcgacatcctttcaccgcgcatcgccgtcgtcggcagcgtgaacatcgacctcgtgacgcgcgcgccgcgcctgccggtgccgggcgagacgctgctcggcacggatttccagaccgttcatggcggcaagggggcgaaccaggcggtcgcggccgcgcggctgggcgcgtcggtcgcgatgatcggctgcgtcggcgacgacgcgttcggtgcgcgcctgcacgatgcgctggcggccgaacgcatcgacgtgacgcacctgggccggatcggcggcacggcgaccggggtggccacgatcacggtcgacgcgggcggcgcgaacagcatcgtcgtcgtgcccggcgcgaatgcgcgcctcgacgccgaccggatcgacgcggcgcgcgatgcgatcgccgaggccgcgctgctcgtgtgccagctcgaagtgccggttgccgccgtcgcgcgcgccatcgcctgcgcatccgcgcaccacacgccggtgctgctcaaccccgcgcccgcgcagccgctgttcgacgcgctgctggcacgggtcgactacctcgtcgtcaacgaaaccgaagccgaatcgctgaccggcatcgccgtcggcgacgacgcatcggccgtgcgcgccgccgatgcgctgtgcgcgaagggcgtcggcaacgtgctggtgacgctcggcgcgcgcggcgtctgctggcgcggcggcgccggtaacggccgcctgcgagcgatgacggtggccgccgtcgatacgaccgcggccggcgacacgttcgtcggcggattcgcggccgcccgcgcgggcggcgcgtcgatggacgacgcgatcggcttcggccagcgcgccgccgcgatcagcgtgacgcgccacggcgcgcagacctcgattccgacgcgcgaggaagtggcacgcctcgaaccctgaataccgcatcagacggacaggccggaaccggccgataccagtgacatggagacaaccgcaatgaacgtaaccccgaccgtcccgcccgcaccgccgcgtatccgtcgcgggcaacgcatcgcgctcgcgctgttgatggcgagcggcatcgtcaactacctcgatcgcggcacgctggccgtcgcgagcgcggcgatccgcggcgatctcggcttgtcgctcgcgcagatggggctgctgctgtcggccttctcgtggagctatgcgctgtgccagtttccggtcggcgggctcgtcgaccgcatcgggccgcgccggctgctcggcgtcgggttgatcgtctggtcgttcgcgcaggcggcgggcggcatcgtgtcgactttcggctggttcatcgtcgcgcgcatcgtgctcggcatcggcgaggcgccgcaattcccgtcggccgcgcgggtggtgagcaactggtttccgctgcgcgcgcggcacgccgaccgggatcttcaacgccgcgtcgccgctcggcaccgcgctcgcgccgttgctgctgtcgatcctcgtcgcgtcgttcaactggcgctgggcgttcattgtgacgggggcactcggtctcgtcgtcgccgttgtctggttcgcgctgtatcgcgatccggtgcgcgcgcaactgtccgccgccgagcgcaactacctcgatgccgacgcgcaaagcgtggccgcgacaccgaaactgacgttcgtcgaatggcgcagcctgttctcgcacggcacgacctggggatgctgatcggttacttcggatccgtgtacctgaactgggtctacctgacctggctgccgggctacctgacgatggagcgccacatgagcctgatccggacgggctttgccgcgtcggtgccgttcctgtgcgggttcgtcggctcgctggtggccggctgggtgtcggacctgattacgcgccgcagccgttcgccggtcgtgagccggcgcaatgcggtggtggtcgcgatgctcgggatggtcgtcttcacgatcccggccgcgctcgtgcagagcaacacggtggcgctcgcctgcatctcggtcgtgatctttctcgcgaacgcggcgtcggcctgctcgtgggcgctcgcgacggcggccgcgccgccgagccgcgtcgcatcgctcggcgcgatccagaatttcggcggcttcgtcggcggtgcgcttgcgccgatcctgacgggcatcattgcgcagaaatggtcgttcgtgccggcgctgctgaccgcggcggcgatcgcgttcgcgggtgcgatcgcctatctgctgctggtgcgcaagccgattcccgagcaggccgcgaacgccgcgcccgggccgttgcccgcgtgagcctaccccgcattcactgaagcaaggagaaacagatgcaacagcagcaagcgaacgtgaccatcgaagggatcgtcccggtgatgctgacgccgttcgacgatgccggcgcgatcgactacgcagggctcgagcggctgatcgagtggtatctcgcgcacggcgcggatgcattgttcgcggtcgcgcaatcgagcgagatgcagttcctgagtctggccgaacgcgcggagctcgcgcgcttcgtggtcgagcgggtggccgggcgcgtgcccgtcgtcgcgtccgggcacatcagcgacgatctcgacgcgcaggccgcggagctgtgcgcggcggccgaatcgggcgcgcagggcgtcgtgctcgtgaccaaccgcctcgatccgcagcgccagggcagtgccgcgttgctcgaccaccttcaccggctgcttgcgcgattgccgtcggacctgccgctcgggctgtacgaatgtccggcgccttaccggcggctgctgtcggatgacgaactgcgcgcgtgcatcgacacgggccggttcgtgatgctcaaggacgtgagctgcgacctggaaacggtgaagcggcgggtcgcgctcgccgagggctcgccgctgaagatcctcaacgcgaatgccgcgattgcgcgggatgcgatgaaggcgggttccgccggcttcaacggcgtgttcaccaactttcatccggatctgtaccggtggttgcgcacgcaaggggatgcgcatcccgaactggccgacgagctttcgacgttcctggtcgtctcggctgtgtcggaggcgctcggatacccggcgctcgcgaagctctatcaccagcggatcggcaccttcgcgtcgatccgctgccgtgcgatcgactacgacgtgcgtgaacgattctgggcactcgatgcggtgctcgacaagatcgtggccggcaccgagcatttccgtcgtcggatcgctgcgcgatagggcgcgtggtgtgccgtccgtgttctgcggtgcgcgacggcatcgcgtgccgtgcaggcggaggctcgcgcgtgggggcgtcgggaggcgcagggcggcgcacagtggctgcaagcacggtcggtttgtcgcgatgcgttgcgttgtgtgcgcgtcgcgacaagcggtgttggtggcgtctccgcgatcgccgatgatgtgaacccggcgcgtgctcggccccaacgtatggcgcggcgaatccatcggcgtttctatgctgtcgagggcggcaagggtacctgtcgcggcggggccgctgcattcgtcgacggtcagcgttgcccgtcgtcatgaatgacgatgggctgtcgatacggcaccgacgtgcggtctgaccttcattcgttccatcgcaccatcccgtcggcgagccgcgagcgccgagcctcaatcctcaatccttaagcgccggtgccgagccgagccgagccgagccgagccgagccgagccgggccgggccaagccaagccaagccccaaccgcagcgccgccgctcgcccgtccgacgcgttgtgccccgcgatctgccgccaccggctgaccggtgcatgttcacgtcgggcgacaaaagcacacaaatctgatcatccccctcatcgtttcttgtaacgattcgtaatatcgcgccgccgagcgcttttcccgacgaaccgttgaatccgcatccgcttcccatgcaacacgtcacgacgacaagccagccaccgatcctggcggcaccggtagatcccatgctgcatgccgtgatcgatgaggtcgtccaccggagcgtgtcggaagcgacgacgcgcagcggctacatgcgatgtgccgactacgcgatcgtcggcgcgcaggtgctgacgctgctgaccggcaagccgtaccggccgttcgcgggtggggaggtgctggatttcggcggcggcaacctgtatgcgctgtgcacgacgcgcgagcggcgccgcaccgcgcggcacctgtcgcagctcgcgaggtatcactgctggatcgaggcgcgtcatgacgatatcggcggccgtgcgcgcaaggaaatcgtcgatttcacgctgcgccacgacgagaccgtggcgagccatctggggatgccgtacgcacgcgcgtaccaggcgtatttctggggatgggacgacgagcacgcggtaccggccgaactgcacggtcatccggtcttcgcgaaacagggccccgtgtggcgctgggcggagcgtgaatgcacgtcgctgctgcgcgcatacgagcgcgaacggccaggctatttcgggcgtcaggtgtcgcgtgcgatcgatttgtttgccgatcgcgtcgaaggtctcggctgacggcacggcctgccgcgatggagcgacccgcggaagggcgcccggcgcatgcttgcgcaccgccggcgtctgcgtgatgtgcccaggcgggacgccgtgcgcggcggcgcgagccggtcgatccattgaccggccgccgccgtgatcatccggcggcccgggcgcgcattacttgttcgccagcgtgccgctgctgttggcgccgccgaacagccgcgtcaggtattgcgtgttcgagttcatcttggccatcagcgtattgagcgccgtgaactgcgcctgatactgcttggtcaattgcgcggcgtagtcggccagatccgtctgctgttgcgtgacacgcttcaggttggcgctcagcgcgttcgtgcgcacttcgatcatcccgcctttcttcgtgaagggcgcgatctggtcggtcagttgcttgcccatcccgttcgtcgagttgaacaggcgcgcgacccctgacgggttgttggacagcgcactgtcgagcttcgcgctgtcggccttcagcgtgccgtccttctcgagcgagatgccgatcgccatcaggttcgtgtgtccgttgccgttctcgttcacgacaccgcgcgcgacgatcgacgcgagcgagttgcggatcgtgttcagcgtcgaatcgccgatcagcgcaccctgcgagctcgccccttccgtgtagctcgacagcgcgcccatcgtcttgacgacggtgttgtacaggttcacgaagttcgtgatcgtggccgcctgcgacttcgtatcggtgctgaccgtcagcgtctgcgtgtcggtcgcgctgaccgcggccgccgacaggttcagcgtgacgccgctcagcacgcccgacaccgtattgctcgcgctggtcgacgcgatgccgttgagcgtgaacttcgcgtcctgcgcgacggcgctttgccgccacgcggccgcgctgttcgccgattcgatcttcgacgcgccgcccgtcgtgtcggcagtcgacgtgacgccgaggttcgacagcccgttgtcgttggccacgttgccgaccgcgacgctgatcgcgttcgccgagcccgtcttcgtcgacgcgagcacgaggtgcgcgccgtcggtgccgttgatcacggtcgcgctgatccccgggttgttcgccgcggagttgatcgcggccgcgatgcccgacagcgtgttgttcgtgccggtgacgtcgaccttgaacgactggctgccgagcgacagcgtcagcgtgccggtgccgagcgccttgctcccgtcgaagcccgacgaagccagtgcctgcgcggtcgcggtctgcgtgacgccgatcgtgtaggtgccggccaccgcgcccgcgcctgccgtcgcggtcaggcccttgccgctcgcgaccgcggtgaaagtcgactgcagcccgccattcgacagcgaggcgaggcccgcctcgagcgcacccagcgccgacgacagcgcgccgaatgcggaaatctgcgtcgtgccggtggtctgcgacgcggcgagcgcggcggcccggccggcggttttcgcgttcaccagcgtcttgacgagcgtgccgacgtccatcgacggattaccggtcgagccgttgatgatcgattgcgccgcctgttgcaacaggctgttcgtgttcgcgccgctggtcacgggcgtgttcgttgccatgggtggtctccggttgaataacgatcccgtgacgagcggctgccgggtcggcctgcgacgcttcgaaggcagggcgcgtccggcgcgacgcgttcccggggttcacgggagtgtcgggaaaacgtaaggacgtgcgctatcgtatatttaaatcggtattacttggtaatttttgtaatgtatgttgagaaaaatgcagacgggaacagggtgtttgagtgagggctaaaggtctgcgatttttgccgtaaacacaccgttttggttgtatttattcaagcatttttcccggtgttgaagactggcaaagggcgagaaggattggtcaaggttttgcgctgattctgctaaacatcggatcgatcgacggtgtgtggaaagggtgtttcccggtcgatgacgggctgaaatccttgtctgacggacgacatgcgtcaccggcgattccagttcgcctgcccgcgaaacgttttcgtattgccgatgttcgtttccgggccatgagatttttctgaaacagaatgcccggtagattgcaatgcgggtcgagttgcgggaatcaagtcggcctttgtgaatcgatattgaacccgtcgtttaatgacgggttcaatatgcgcagttgtgaccgatttgtgtcaattgaagccgaaaatatcgattgaatcaggtggcctgaaagaagcgtggcgtttccgtgttccggaaacatgctgcgggttgatttgcactgcctgcctacatttgcctgtcggcgcttttgtcgtcgattgtccactttaatgagacagcgaatccttctttggcggattgatgattcgtgacgagacagtagactgcatccgtgcttcgccagaaccgatcggaagcgcgccgggaacggcgcaacccgacggattcttcggcggcgggcgctccggcctgctgtccgatcgtgcgaggagtgattcggcgcctctcggcaccggatgcatcaaaccgtcaattcaagggtgatattgctatgcgttacgtttcgctggagtcgaagaaggacgagctgctgctggcggctcgcgtgctgttgatgatcctgttcgtgctgttcggctggcagaagctgagcggcttctcgggcaccgtcgcgtacatggcgtcgacggggaacccggcgcccgaactggccgcggtgatcgcggtggtggtcgagctggtcggcggcctgctgatcgcggccggcttctatacgcggccgctcgcactggtgttcgccgcctatacgctcgcgaccgcgctgatcggccatcgctactgggcgctgcagggatggagcaatacatggcgatgatcaacttctacaaaaacgtgagcatcatcggcgggctgctgttgctcgcactgaccgggccggggcggtattcgctcgaccggaagtaaggtggggcggcgtttctgtccggctcggagcccggtgcacgaaagtgcgccgggttttgtttttgggcggggcgtgacgtgtggcgcgcgcggcgtgggtgctgcgttgccaaacgaacaggttccggacatgattgcgcgtgcacagtgacgctgttcacgccgcggcgtctcgcagaaatcgtctgcttcaggacattgccgacggagaacgacgactatccgcggtttaccgaggcatggttcgagacgctgtacccgcactacttgcgcgcgtttccgtcatgttcgatcgcgcacttcgagatggacagcggccgggcggcacagatgtcggccgccgtcaccgtgccgcgtggtacgcagcttgacagccggccactgatcgacggcgtcgtgaagcttgcgcggaaggcggtgacggcgtggattgccgagtcaagatcaacggcgtgcagacgaaccagtttcagttgggagaatcggagaagtcgatgacggtcaagggacatgatcggccgttgacggcgggcgagatcgagatggcccggaccgtcttcaaggacagcatcgattacgacaaggtgcgggtgcatcggggagttacttctggttcgacatgcagcgcaagagaaccgcagttacccctgacgggcacatgtattttcgcgacgaggactttctcgaggacttctccgccgcgtcggtggcggatggcgacatgtcatggttcatgcacgagatgacgcacgtctggcaataccagctcggatattcggtgcgctggcacgggctgaccgtcaccattcgcggcgagcgtgcctatcagtacaccatcacgcctcagaacgtttttcacgactacaacatggagcagcagggaaatctggtcgcggattatttctcgattcatgtgctcaagaaataccaggcgatcattcaccgcggatacgtcggcgcgccggaagaactcgactgggtgctcgcgccgttgctgcgggatccgaagaatacggacaatttgccgaagtagcgggacgggcgccgtcgcacggtggcgatgtttgaattcctgattgactcgagtggtttcgatgccgcgatgaatggatgcgaagcgtgagggaaattttgcgaagcagtgccgtggcatgcctatcgtgctggttgtttacctcctgtgcggttgccacgtcgcacggtccgattcgcctggacatcaggcagatcgacggaaaaccggctgcttgcctgccggcaagtgacgacactggttccgacccgatccagatccgcggggtcgatgtgacgagacaaaccggcccggtcagtcccgttgtcacgtattgggcgctggaggttccgggagtgcgccgccggtttatctgaagcgaggcgcgtgtctcgtctatggccagaccgtggccggtgcggttgtgcgtgcggcgccgagggcgctggacatcaacaagttctacagcatctcgatcgtaccgggaggggctatggcccggtgtacagctcggcgttttgcgtgatcaggcaagcgggggcggtgtccgcattgcgacgccggggcaggaagggaacccgtgcgcgtcggcaggatactgagcggcgcagtgggcttcgcgtcgtggcgttccggtcgcgaatgacggcgcggacaaggttgggccgggcgccgcttacgggtttcaccatggttatgtcgggccacccaagcgcttgttcgcattcttgtgccgttccgggaggattcaggtagtgcagacaggcttttgaagcagcgcgccgggcttgctcgcggcgctgtcgtgcctgtcggacgcaatggcgacgtcggtggcgcccgtcgaactggagatcaggcaggtcgacgggaatcctgcagcctgcctgtccgcgaatgacgagcgtgccggaagcgtcatccgaatccgctcggcgggtgtcgccaggccgaccggcgccgcgagtcccgacgtgacgagaagacaggcatgcagccgacgagtgagggagtcgacatcggttgcctgttcttgtatagattgggaatccccgttcccctttcacagatggctaccgtgccgcaatcgaccgtccttctcatcggcgccgccggcctcctcggccgcgcggttgccgcatcgctgtcccgcgagtcttcgttaaacctcgtcgcgacgatccgcaacccgcacggtgcaggcgcaaaacgccttgcgttgccggcggaaaacctcgccgaactcgacgtcctcgacgagccggccctcgaacacctcttcgccacccgccagccggccgccgtgatcatctgcgcggccgaacgccgcccggacgtctgcgaacgcgatcctgacggcgcacgcgcgatcaacgtcaccgcccaggcgcgcatcggcgcgctcgccgcgcgccacggcgcatggacgctcggcatctccaccgactacgtcttcgacggcaaggccgctccgtaccgcgaggacgccaccccgaatccgctgaacatctatggccgcacgaagctggaaggcgaggcggcgctcctcgccgcgtcgccgctgtcgtgcgtgctgcgcctgccgctgctgtacggcccgatcgtcgactggagcgaatcggccgtcacgagtctcgtgccggcgatcgccgcgtccgctcggccgggcgccgacgcggtcggcatggacgcctgggcgatccgttacccgacgatcgcccgacgtcgcggacgtcatccgcgacctgacattgcgccatctcgcgggtgcgtcgatcacgggcatccgtcactggtcgggcgaggagccgatgacgaagtacgacattgcgcagcggatcgcggccgcgctcggcatcgaagcatcgctcacgcggatcgaccagccgaccgacgcgacgccgcgtccgtacgattgccatctggacgcatcgcgcgtgcgcgcagccgggatcgatcacgcgacgcctttcgatatcgcgctgcgcgccgtgctgcgcgatgcgccgcagacgctgtaggatcgggcgccacgcgcggcccgcgccgcgtgatttgcagccgtccatggcggcagccgcgcgccggaggcggcctgcgcgcaccggccggcccatcatcgcccacccaggagcccagccatgcaactgaaatggctcgaagacttcgtcgaactcgcgcgcacgcgcagcttcacccgcgcggcggagaaccggttcgtcacgcatccggcgttcggccgccgtatccggtcgctcgaggagtgggtcggcgcgcgcctgatcgcgcgcacgaagccgctcgaactgacggcggcgggtaccgtgtttctcgatgcggcatcgaacgcgctcgacgtcctgcacggcgcccgcacgcaactccaggaagcgtcgccggtgctggagaacaacctgcgaatcgcgaccggccgcacgctctcggccaccttcttccccgactggtacgacgagaccgtcgcgcgcgccggtttttacggcgaccgtgtcgaccggcagcgcggaggaagcgatcctgcagctcacggccggcgacgccgacatgctgatcgtctattcgagcccgcatacgcggctgctgatcgatcgcgaccgcttcgactggctgtccgtcgcgcgcgaggtgctggtgccggtcagcgcgttcgatgcgcgcggcagcgtgcgctaccggctgccggccgggcaggcgccggtgccgtggctcgcgttcgcgcgcacgctgaccctgcgcgcggtgctggcgcgccatctcgccgaaatgcccggccgcccgacgttgcggcccgtgtaccaggccgactcgtacgaagcgatcctcgcgatggcgcgccgcgggctcggcctggcgtggctgccgcagcggctcgtcgccgacgacgtgcggcgcggcgagctcgcgatcgtcgggggcgccgactggcagatcggcttcgacattgcgctgtaccggcgacggaacgacccgcacccggtactggacgcgatctggcgcaccgcgccggcccgcgacgacggcgccgcgtagcctccgcgggcagcgcccgcgcggcctgcgcgccgatcggcacgattgcgtgccgaaacggcacgaacgcccgccccgcgttgcctacactccgcgcttgactggcccgaacggccgccggcaaagccgcgcgacgtctttcaaaatcctgacggccagcattaccggaggagcaaagggatgacccgcaatacacacggcgcgacgccggccccgcacaacccgtggcgcgagatctgcgccgcgagcatcggcaacgcgctggagttctacgatctgctgatctacggttacttcgcgatcgtcatcggccagttgtttttccccacgcacgacgcggcgacttcgctgctgctgtcggtcggcacgttcggcatttcgttcgtcacgcgtccgctcggctcgatcgtgctcggcagctacgccgaccgcgcgggccgcaaggcatcgctgacgatgtcgatcgggctgatgatgctcggcaccgcgatgatcgcgttcgcgccgacgtatgcgcagatcggcatcgcgtcgccgttgctgatcatcgtcgcgcggatgctgcagggtttctcgacgggcggcgaattcggcgcggcgaccgcgttcatggtcgagcaggccgacgcgaagcgccgcggcttcttcgcgagctggcagatgtcgacgcaggggctcgcgacggtgctcgcggccggcgtatcggcgctgctgagcctgctgctgacgatcgaccagctgcacacgtggggctggcgcgtcgcgttttcggtcgggttgctgatcggcccggtcgggctctacattcgccgcaacatcgacgaaccggccgatttccgccggctgggcgaacaagggcgcgcgaagtcgccgctgcgcgacgtgttcgtgcgcgatcgcgcgaacatgctgctcggcgcgggggtggtcgcgacggccacggccttcaactacgtgcacaagctgtacatgccgacgtacgcggtcaagcagctgcatatcccggccacgtcgtcgtatctcggcgcggtcgtcacgggcgcgatgctgatggtcgccgcgccggtcgtcgggcatctgtcggaccgtttcggccgcatccgcgtgatgctgatcgcgctgatcctggtcggcgtgacgacgtggccgctgttcgtcatgctgaaccgctatccgacggtcgagacgctgctcgcggtccaggcgctggtcggcctgttgatcgcggtgagcctcgcgccgctgccggcgctgctcgccgacatcttcccgacgagcacgcgcggcacgggcctcgcgctgtcgtacaacttctcggtgacgctgttcggcggcttcgcgccgctgatcgtgacctggctgatcgacgcgacgcacaacaagctggcgccgagtttctacgtgatggcgacggccgtgctcgggatcacgtcggtgatttcgctcggccgccggatgcgcggcacggcggccgccgccgcgccatcgacacgcgcgaccggggcgtgacgcgccggccgcaaacccgattccggcgcagccggcacacgccggccgtgccttttccgaaccttgttgagcctttccgacatgaccacgcttgaagccatccgcgccgccttgccggcctatccgatcgaagtggccttccccgacatctcgcgctggcgcgcgggcaatacgggcatcgactatctgcatacgttcgacagcggccggcccggcaagcacgtgatgatcctcgcgctgacgcacggcaacgaagtcagcggcgcgatcgcggtggatacgttgctggccgcgggcctgcagccggttgcgggccggctgtcgctcggcttcggcaacgtgggcgcctacgagcacttcagcgcggagaacgccgatgcgacgcgctacctcgacgaggacatgaatcgcgtgtggacgccggccgcgctcgacggcacgcccgacagccgcgagctcgcgcgtgcgcgcgcgatgcgtccgctgctcgatacggtcgacctgctgctcgacattcattcgatgcacgaagcgtccgcgccgctgatgatgaccgggccgctcgagaaggcgatcgcgctggcggccgcaatcggcacgccggagcacgtgatcatcgaccgcggccatgcgaacggcacgcggctgcgcgactacggcggcttcggcgacgcggcgagcgcgaagaatgcgctgctgatcgagacgggccagcacttcgccgcgagcgcgcgtgacgttgcgctcgacagcgcggcgcgcttcctgctgcatgcgggcgtggttgcgcgcgacgacgtcgtggccttcctcacgcaggccgtgccggtgcggcagaagttcgtcgagatcacggagccggtcgtcgcgcgttcgatggatttccggttctcgcaaccgttcacggggctcgaggtgatcgggaaggccggcaccgaaattgcccgcgacggcgaccatgtgatcgtcacgccgtacgacaactgcgtgatcgtgcaaccgtcgatgcggcatctcggcgtgaacgtcacgatgatgcggctggggcgcttgctggatcggtgacgtcgcctgtggcggaccgccgggaggcggcccgcgcggtcgcgcttctcagccgatgcgtggtgcgccatgccgcatgcgattcacgcgtcggcgcgggcggcgcagaccgaacagccagggcgcccgtgcatcgatgtgctacgcgtgtcgcttcgggttccacgccttgtgtacgaattcgaggcggttgccgtcgaagtcggctacgttggcggcgtagtagccgggggcgaaataggtacgatccgccggtttcctcgtcaatcccgccggccttgatcgcggcggcgtaggcggcgtcgaccagttcgttggtatcgcagacgatcccgacgtaaagcccggtctcgccgggatgacgtttgcgcagccagatgctcgatccgactcccgctcccttgccgtacacatcgtcgccgatgccgtaaagatcggggacgctttccgggcccgaggcggagtcgtagttgccgaaaatgctccagccgagcggcttcaaggcttcagcgtagaaggccagtgatttttcgatgtcggtgactgagatgtaaacgtggtcgatcattgggcgccttcgacggggatgggtacggtctgcgcatggcgatatccgacagccgggcgtctgctcgtggccgggccccgacggtcgccgacgcagggatgcctgatgctacggccgtgcatgcgctttcacaagccgcacatggaatcacgcgcgagcctggcgcaacgaaccgggcatccggctcggcgtgaacgtcacgatgatgcgatggaggcgacaaacgccggacgacgcctgaatcgcaatggcaagccggccggcttcgtcggtacccggacgggaatggcagatggatgaacaggtagcgggcatgcaggtgcgatgtcgcgcagtatcggcaccccagcccgcggtggtgctggattcagaccgtcaatccagcaccgggcttcacgtatcgataatcgtcgagcgcttcaagatcgattaacgaatcgcaaagcgggtcgccggagagccattcgcgcaattatttccatagataaaaagatttctgttttcagaatatgcctggtaaataatcgaataaacttccttggcactgaacgagtagacgccatcgttgatcgtcaccagcaggttgccggtggtgtcggtttcgatcttgtcgatcttgccggctttgcaaagcgcctgtgcggacgcgcacgtggaggcgagcatcagtgccgaaaacagcacggttgcaatcttcttcatgactttcctttggaattgaatgaaatgatgcgatctgacgacgtcggccacgtccggaaagacatgtctgtccttccggattgctgattcgcaagcgtctggaaatcaacggggcctggcaagctggaactttgcgacaaagcacgaatgaaatgattcgtgctgcgcctccgttacctctttgatttttgaatcgcggtgttgcggcgcacaacacagactatttatttggatttgagggcgccaatcgaattaatttatcgttaatggaattcgataatttttgtttgaatttgatttaattgaattctgggtggagttgtttttatttttgattgtttcgatattcaaataatcggcgacgaatattgaggcgatgatcgatagtggtgccggcgcggcaggcgaagcgcatgggcgttcatggggttcgatcgttcgagcgcgggaggaatccatggcacgaagcgactcgtgcccgaacggaaaggcgctacactgcgcgggttcccgggcacaccgggagcgccagggcgtcgggcacacggtttgccgacacgcgacgatggttcgcccgcaccccggctcattcgaacaaatcacgagagcaagagagggcccatgctgacacgtcttcgtatcggtctcgatcgcgcgcgcgacctgcgcgaagcggggcgaccgtctcccgtccatccacggccgcaggcgagcgaactggtcgacctcagcgcgcagcgcgcgatgtggcgtgtcgccgttccgggccaggccgactgctacatggcggcgacgcccgccgaaacggagcgctacgtcgtgcatctcgacgcgcagacgttctacggcctgtggctcggcacgagcccgagattcccgcagccgaactcgcaggactgcgtgccgcgccgcgtcatgccgctcgacagcaagtacgcgtcggccgccgccgcgttccgggccggccgcctcgaaccggtggcactgccgccggtcggctactggatcgagggaggcgggtacgaagtcgcgatgagcaacggcatgacgcgcaccttctggctgctcgccaaccgcgtgcgttcgtttccggtcagcgtcgacaacgcgacctgggccacgatgctgaacaacatggccggcgtcggcgtcgcgccgatcgcgtaccgcgaactgttttcccggcgcgcgtaggtcggtcgtcgcgatccggcagcgccggatcgccccggtttgacacgccgcgttcgcggcctttaaagtcgcatcgcgggccggtgggtcaagctcacgcccggaacaggcagccgatgttccaggactacggggctaccccgtggatcagatcgacatcccgatgcgtcgcaaggagcgccgttgcgcgttgcgcaacgtgactcctcgcaatacccgtcacgttggctcatcgtcccgcccatccttttccatgtcttcatccctgcgcgataccacccgcacgattgccgaggcgatgctggccggggcgcccgaacgtgccggcgtcctgtcccggatggcggcggtactcggcggcgcgccgccgtggactcacgaagtcgcggacgccgcgctcgtgcgcttcggcgcgcgctgggccgatgtcgatatcgatgcgcttgcggcgcacctcgccgatgcgccgccgttcgtgctcgcgtggtacggcagcgatcggcccgccgcgatccgcgtcgtgcggcggccgctcgtccagctgccgttgccggcgccgctggccggctgcgacgtgccgcaatgggcgaccccggcgatctcgccgactggctcggcgtgcgcgtgccggaactcgactggctgtccgaccattggcgcgtcgacgcgcgcagcggcgccacgccgttgcatcactacacgtacgtggcgcacgacaagcgcagcggcgggtgccgcctggtcgagatcccgaagggccggctgcgcgaagcgcagcgccgcatcctgcacgggctgctcgaccgcatcgcgccgcacggagcggtgcacggttttcgcaaggggcacgggatcgtgtcgttcgcggcgccccatgccgatcgcgatatcgtcgtccgtttcgacctcgcggatttcttcgtatcgatacgcgccgcgcgcattcacgcgctgttcgtcacgttcggatacccggccgaagtcgcgcgcacgcttaccgggctgtgcaccaaccgcgtgccgtccgcgcggctgctcgcaccggatctgcgcgaccggttcgactggatcggccgtcagcgctatcgagaacggcatctgccgcagggggcgccgacgtcgccggcgctggcgaacctgagcgccttccggttcgacatgcggctcgccgcgctcgcgcgttcgctcgatgcaacctacacgcgttatgccgacgatctcgcattttccggcggcggcgcgctggcgcgcgacgtcgagcggctgcaggtgcgcgttgccgcgatcgcgctcgaggagggctttgcgctgcacctgcgcaagacgcgcgtgatgcggcgcggcatgcgccagcaactcgccggcgtggtcgtcaatcgtcatccgaacctggcgcgcgatgagttcgatctcctgaaggccatcctgaccaactgcatccggagcgggccggcgtcgcagaatcgcgatgcgcgtccggactttcgcgcgcatctcgccgggcgcgtcgcgcatgcggccgcgctgaacgcggcgcgcggcgcgaagctgcgcgcgctgttcgacaggatcgcgtgggacgcctgcgacgtcggtctgtaagcggccgaaaagcgaccaaaaagcgaccgggtccggatcgacgccggccgacgacttctgcatcgcgatgccgtgcactgctatcattcgcgccatgccgcgccagtgcctggtgcggcgcctacttgccgcagtcgttcgcccgtgccttcgtatgcggcgggctgcgcgttgccgggccggttcagtctgtcatcgattgacgcgcgacgtcgtttagtgcgtatcgcgcaagccacgccggctcaggcaaacgatacatacatttgacagcacccatcggcggaacttcgtggtaggttccgccatcggagctttgcgaaaacatgcccaaagaggatgaatacatgacccaggccctgcaggaactcgaagcacaacttcgggacctgaatatcaagctgtcggatgcgaagcagaaggagaagcaggccgcgctcgcggcattcaaggaacaggtcgagcttttgggaatttcgcagcaggaagtgctgagcgcgctcggttatatcgtccagcgaaaacgcaaggcgcctgccaagtactacgatccgacgaccggccgctcatggtcgggccgcggcccgcggccgaaatggctcgaaggcaaggatctcgacacgctcgccgtcgaccgcgaggccaagacctggtggcccggagacgaccagggctgaagccggccaggccgccggaccatccggcgccctccggctcgcgcaagcgggccggccggcaacctgctccccacgtagtcgttcatccggtgtccggcctggccgcgacatcgccggcttcaccgccgacaccggcccgccgttttccctcccgttcatgacccgcaggttgccgccatgccgtcccgcaggcgggtgccggcgcgcgcggaccctcgccactggccgacctgccggcccttcgttcgcgggcacaggccttagaatgtcgccggacaatcgtggcaggacatcatggcagcaaacatgaaatctccgacgctcggcggcccgtcggccccgcgcgtcgagcaggtcggcgcgtacgcgtggaaagcgctggccggatcggcgatcggctatgcgatggacggcttcgacctgctgatcctcggcttcatgctgccggcgatcacggcggcgctgcacctgacacccgggcagggcggcgcgctcgtcacctggacgctgatcggcgccgtcgcgggcggcatcctgttcggtgcgctgagcgaccgctacgggcgcgtgcgcgtgctgacctggacgatcctgctgttcgcggtcttcaccgggctgtgtgcgttcgcacagggtttccgggatctgctcgtctaccgcaccatcgcgggcatcgggctgggcggcgagttcgggatcggcatggcgctcgcggcggaagcgtggccggccagcaaacgcgcgcgcgtgtcgtgctacgtcgcgctcggctggcaggccggcgtgctgctggccgccctgctgacgccgttcctgctgctgcacatcggctggcgcgggatgttcctggtcggcgtgctgcccgcgctgctcgcgtgggcgatgcgcaacaagctgcacgagccggaggcgttcgtgcagcgcgcggcgcagccgaaggccaacgcgttccgcctgctcgtcgcggacggccgcaccgcgcgcacgagcctcggcatcgtgatcctgtgttcggtccagaacttcggctattacgggatcatgatctggttgccgaccttcctgtcgaaacagatgggtttctcgctgacgaagtcgggggtgtggacggcggtgacggtcgtcgggatgatgatcggcgtctgggtgttcgggcagctggccgaccgcatcgggcgcaagccgacgttcctgctgtaccagctcggcgcggtggcgacggtcatcgcgtatgcgcggctgtcggaccccacggcgatgctgtgggccggcgcgctgatgggcatgttcgtcaacgggatggtcggtggctacgggacgctgatgtcggagggttatccgacggccgcacgcgcaaccgcgcagaacgtgctgtggaacatcggccgcgcggtgggcggcttcggcccggtcgcggtcggcgcgcttgccgcgcactattcgttccagacggccatcgcgatgctcgccggcctctacgtgctcgacatggtcgcgacgctgttcctgatccccgagctcaagggcgtcgagctcgaatgagcgcggcgatcgcacgcaatccaaccccttctccggaaaccacgatgcagcagaagaacaggacgatcggcgtgatgggctcgggcaaggagccgtggctcgcgttttcggagccgctcggcgcgtggctcgcgcaggccggtttcaacctgctgacgggcggcgggcagggcgtgatgctggcggtcgcgcgggcgttcgccggcgtgcccgggcgggccgggcgatcgatcggcatcctgccgacgcaggccgatccgctcgcgggcttcgtgccgctcgacggctatccgcatccgttcgtcgacatcccgatcctcacgccgctgccgcgccgcgagccggatgccgagccgcacacgatcaaccgcaactacgtgaacgtgctgagcagcgacctgatcgtcgcgctgccgggcgggcacggcacggccgaggagattgcgctcgcgcggcgctggcgcaaaccgctcgtctgcttcgggccggaggggcgtttcgcgtgctcgcggcgggcgccacgtgcacgtcgtcgctcgacgacgtgatccggttcgtggaagacgcgttttcggtggagcacgcgaagcgatagttcatgcaatcggcctcggtggagatcggacccgctcgtgtcccggccggtcgtcccgcatgccgagtgcacgctcactgtcgaatggcagccattgcatcatggtcgagccgcgcgcagaggcatgaccgatggtctcgcaccacatctggcccaggcgccacgggggcgccggtcgacatgttggtagatgcggttcacgtcgtgacggtgttcgcggcggtgacatgcaacacggtggggcgtgcggctccggcaggagtacccctgccgggcgaggcgccgaccggcaaaccagtccgtcaagacgtgattgccggtgaaataaaacaaagagactgatttttagaatatataaaagagatccgttgattgttgtttttggcatatcacacctagaataatcctggttagggcctggattttagatgggttgatcgtgttgattaaacggattgaaaaatgaacgagattgtttatatcgtcgcggagcgatcggggtattttctcggtaaatatttgggctggctgatatacccctatctcgtgatattgaaaggcggcgcctggaatattcagcaaagttttgaagggctcggacttgtctcgtcgaattttgtcgagcaggatgcgcaggggcaggtcgtttcgagttattggtcgccaggcgaagcgatgctgccgattctggtcgtgctctggatactcttgctggtattggcgttcctctacatcacgacgggatatgtgctcgccaggaagaagggggccctggttgcattgtcaattcttttgctcccggggttgctggtactgcagggctggtggcccttgatttcgcttgtgcccgattcgttcgtcatcggcgggagcggtgtgctgggcagcggttggggcatgctgacgctggtaggcttagggctggtcgcgggatggtgcggcgtgcttgtgctcatcgacctcctgccgatcggcgacggtttcgggcatgtctacgatcatgtttggtacgcggccgcgttgctcgcgggcattttttgtgttcgattcgcaagcgaaccggcatgtccagtctctgcaggagagttcgcgcgatacgcagagagcaagcgcctatctgttgaagcaggcggaacggtatgaatcgtggtgcgcgcagaacaggctggggagagcctgtcatgccgctgggcgtcgagcgtgcagcaaacactgctcgattactcggcagaagatccggctgtctttgtcgtcacggggccgcatgccgccgcggatatgtaccagatcaacgggcgacgtctgacaccggagcaaattacgtcattgcgaaacgaaattgcgacatacaacgaggacatgtgtcctgttacgcggatcgacgatagggtcagcgtgatgccgccgtcatcgtcgcggtgcctgagaaccccgatacagttctgcgcgtcgtttcccgaacggcttgacgggcgagacgtcaggcacgatgcgttcaatccggcatcgcttgcaagcgaatgtgtcatctcgacactcgtcgcgtttcgcgaccaacaagagaaactgctgacgcaggtcaacgacgatcgtcggtcgaagcactatcgatggatctactacgtgctttttccattgtcatcggcgggaaaatcgcgctggcgacggccaagacggcgggcttgaacaagcgcacgccgaccgagaggcggagaagcctgcactgggttagtcgtctctggcagatttcatggagaggattgcagatcatctggtgggtgatcgcagggagcgcggcgatctgcgtggcattactgcgattcgcgatgccccggagcggaaagcgataagtcgagaccagctggcctttgcgacagcccgattgacggtagccttacgcggagagtcgcgcgaccgtccgtcgcgaagccgatgtctgacgagggctcgtcggtcagctggggcaggcggtcgacgccttgtcggataggtcgactattccgcagccgatcggaaccgtgcctgcggcgcgagccgccgctggcacggttcagtcccgcggcacgacgctcagcgccccgtcttcaactgcgcccacagccggttctgcagccggcgaatctcgggcggcatcggcttgagcagcgtcatcctgctcagcacctcgtcggccggatacaccgacgggtcgcgcgcgatcgcgggcttcacgtactggcgcgcggccttgttcgcggtcggatagaacaccgcgttggtgatgccggcgttgaccttcggatcctgcaggtagttgatccacttcagcgcggcgtcgcggttcggcgcatccttcgggatcaccatcatgtcgaaccacagcagcccgccttccttcgggttcgcgaagcggatctcgtacgggcgcttcgcttcggcggcgcggcggtgcgcaatgccgacgtcgcccgaatagccgaacgacacgcacaggtcgttgttcgcgagatcgttgatgtagcccgacgagttgaactgcgtgatgtacgggcgcaccttcttcagcacctcgtacgccgcgcggtagtcggccgggttcgtgctgttcgggtccttgcccatgtattgcagcgtggccgcgaacacgtcgaccgcctggtcgaggaacgatacgccgcagctcttgagcttcgccatgttggccgggtcgaacaccagcgcccagctgtcgaccggcgccttgtcgccgagcgccttcttcaccgcctgcacgttgtagccgatgccgtcggtgccgtaggcccatggcacgccgtactggttgcccggatcggcgtcggcgaccatcttcatcagcagcggatcgaggttcgacaggttcggcagcttcgacttgtcgagcggctggtagacgctcgcctgaatctgcttggccatgtagttcgacgtcggcacgacgatgtcgtagccggaattccccgacatcagtttcgcctgcagcgtgtcgtcgctgtcgtaattgtcgtaacgcacgtggaggcccgtttgcttctggaagttcgggaccgtgtccggtgcgatgtagtcggaccagttgtagatgttcagttcaccggccgcgtgggcggtcgtgccggcggacgcggcggccgacagggtggcggcggttgcaatggtgcgggcaagcgtgcggattcgcatgacgaggtcttccattttcagggcgcgtgtcgatccgcgatgcgcgggccggtgcgcgacggttcatcggatgaagcgggcgtgcgcgagcaccgctcgcggtgagcgagcgcggtgcacgacgatcaggaatccgttcgattgcgggccggctcgcacggaaacgaagcgcgagcggattccgtcaccggtcgggcgacacggcgggcaggtcgaacggatgcagggaaaggggtgaagcgctaaggcagcagcgaggccacgtcgtcggtatggatcgcgacgtacgcacgcgcggcgacggcgttgtggcggcgaacggagcggcaggacaggatggtgtagatcgacagatgcaggcgaggactttgccagccgtcaccactgtcgtcggtggacgcgatcgcggcgcgcaggtttcgcgcatcgcctcgtctccaccgcaccagcgggccacggaatctcacgtttactctcgaccgggttgttgaaagtattgaacacctgacgattcgccagcgactgccgtttcaggccgcggtcatcgaatttgccgcgatgcgtcatcggtttcgagacgcgaactgaaagcttggcggaccgctggatcgccgaaacatgacgcttccgtgaatcatcaggtaaatcgctgtaaggatgtctcgggattttccctagtgattcgcaggccgatgcaggcgttcggcgtgatcgcgataacggatgaaccgcgcacgcgacgcggctcgagcggccatgacgggcgtcaagtgatgagaatattcgacggcatgcagcccatcgaccttcagccgccggatggcccgggccggctgaagcgctgctcgaccacctccgtgccccattgcgtgcccgcggattcgctcgtcagcgtgaagccgaacgactcgtacaggtggcgtgccgaatcgaggcccttgaacgtccacagataggtttcgcgaaaccgctgtgcgtcgacgaagcgcatggcttccgtcatgagccggcgcccgatgcccgagccgcgcaatgcgtcgttcacgatgaaccatcgcaggtgcgcgacgcccgttgccgggtcgccgtcgatcgcgagcgacgcgagcgtccgtccgtcttcctggcacagccagagcgccttgccgtcggccggcagcgcaccggcgaactcggccagctcggtcgccacccgcttttcgaaaaaggcgccgaatccccagtgttccgaatagaagcgcgcgtgaaggctcgcgatatcgccgatgcagcccggctggtagccttcgcggatcgatggcgcatcgggtgtcgcggcgcttgccctggcggcgttgtcctgcgcgagcgcatcggcatacagcgcgagcgagcgcagcagcgcctgttgatccgccggcaccatgcggcgcaacgcattcgacacctgatccgtcgcgaacgcgtcgattctttctggagtttcttgccgtcggcggtcaggtacagctcggtcgcgcgcgcatcgtcgctcgatacgcgccgttcgacgatgccggccgcctcgagccgcgcgagttgccggctcgtgttcgacttgtccagccgcaggatgttgcccagatcgcgggcgttgatgccgggcgccatcccgatctcgaggatcgcgtgaactgccgaaggcgcccagtcgctgtcggccagcgtcgcgcgcatgaaaccgagctcgcgaaccagtttgcgggagaagtcgcgaagctcgaggatggttgcttcgcgaggcttggcgggagcgtcgatgaggtccatggtcagcccggaaaggttgcggatcgcaatcaataatagttgcgggtcgcaacttgatcaaggcggattttcatcgggacgcgtcgtgccgagcggtgcttgcggggccggcgtcggcgcggatcacggggacggatgggcgggcggtgagtggtattggcgcggatggcggagtgccgcgcaccggacgcatactcgatgcatccggacgccccgccatgcgagcgcgggtgtcggccggtctcgatccgcggcggcggacaacggagcccaccatgaacaatctgaagccgatgacgattgcgttgcttgccggatgcgggatcggtgccggtgccgttcacgcggccggcagcatggatgcgccgccctgcagcgcggcgcatgcggcggatcagggcgggatcgccgcgatgccgggcacgtcggtgcacagcttttcgaccgccggttgctcgggcgcggtgctgcagggcgaccgtgccaccgcgacggtcaacggcgaccggatcgagctgcgggacggcgtcgtctacgtgaacggccgttcgtacggcgccgtcacaccggcgcagacggtcgaatacgaagccgcgcacgaccggcgtacgttgaaggtcgacgggaaaccccgcacgccggtgcgctgagtccgcgcccgggcccgcggcaaccgcgtcgcgcctagtcgaccagcgtcagccggccgtcgctgagccgcacctcgcgcccgatccacgccgcatcgacgcgcggcagcacggccgacggcttgcgcagttcgcgcagcagcgtcgcgccgtgcgacagccggccgcccatgcgcgcgatcaccgcgcgcgcggcctggtactgcgcgtgccggcccgggtcgagcgtgtcttccagcaggatgtcgcgcccgagcacaccttgcgtgtggcccggatagatcatgaagccggccgcctcgtcggtgctttcgctgccgtcctgccagaagctgccgttgcgttcgcggcgatcgggatggggcgcgaaccatgcgtcgcggtcggcggccggcatcgcgtgatgcagacggaagaacacgcgcatcaggttgtcgcgataccactcgcgcacctgcagataccagccgcgcatgccgggcgcgccgagcgcgtggagcacgcggacgggcagcggccagtcgggaaacgcctgcaacggcagatcggcgggcgcgggccgtgcggtgcccggatcggtctcccacggcaggcgatgcgggctgttctcgagctggccgtatgcggtcggcggacggccccacagtgcgccgccgctgctggccagcgatgacgcgatgcacaggttgccctgcacgacgaacacgtagaagcgcgtgaaccagtcggccagctgccggccgtcggcgcgttgctcgacgagcgtcgcgagttcccggtcgaagcgctgcaggccgcgttcgagcgtcggcagatgcccgcgtgcggcgcgcagcatgcgccagaacaccggcagcgaacgcagcagccgcagcgggcgccagcgcagcggcggggtcgcgccgccgatctcgccgctgtagttgccggccgatacgccccagtcggcgagacgggcgaggaacaggtcgttgttgatgtacgacgcgccgccatagagcgcggtgaatggttcgttgtcctgcaatacgcgcgcatcccagcgcgccatgatggccgggatgctgccggccgcgcgccgttgggcgtactcgaccagccggctgggctgcggcggcaggatctcggcgatgttcgcggcggtcaggtgccggtgccagccgtagctgctgatcgggcggtattgcagcagccacagctgcgtgccgtcccacgcccattcgacatcgcccggcacgtagtggaacgcgtgcagcacgcgttgcaggaaggtccacagttgcgtcgcgcccaggccgtgcgcgcccggaaacgtgccgcgttgccagggctcgccgagccgcgacaggatcgcgcgttgcgggctggtctggccgtcggcgagcgattcgaggtggccttccacccattcgacttcgaccgcgagatgccgcacgaacgcgatgcccgacagcaccggcgtgatgaagcgctgtacgaccgtttcctcgaggccgccgtcgagcagctcggccacgcgcgcggcggcctgcgaggccggtacgcgcaggaacgtggtgtgcaggcccgcgttggccgcatcggcctggtcttcgccatggctcgacgagcggatcgcccactcggcgtcgggctggctcgcgagaaagccgggcaggcgcggatcgtcggcgcgggtcagcgacagcgcgggcggcacgggcaggccggccatcgtcgccagcgccaggcgcccgcccttggtgtgcgcgacgaacccggcgtcgcccgcttcgagccactgcgcgaacgcagccggcgcgtcgatccacggatagtgtccccagccggcctgcagcgtgacggtgagctcggcgcgcgcgaggatggccgaccatgcggcggcctggcgcatgccgagcacggcgtcctggtcgccccacacgagttcgatgcgatcggtgatccactcgagcagcggcagcgcggtatcggcgcgcacgagatcccagtgcggcaggaacgcgcggcagcgcgcgtagccggcgcccatgcggcggtactgcgcgcgtgtccaggtcaggttcgagaacttgcgggcgaacagcgccgggtagtgcgcgagcagccagtgaatggtcttgcgcagcggcttcggcgccatcagtttcggcaggcgccgttcccacagaaatgcaccgacgggcgcgagcagcacgctgcggccgaagtggccggggcgccgttgcaatgcgtgcagcaccagcagcgcattcacgccgaccgccatgatcgcgtggcccggttcggtcgcgtccagcagcgcttgcgcatacgcggcgagatcttcgcagggcggcgcggggttgtcgccgaagcccggcagttccagcggcacgggccggtaatggcggaagtggggcagcgtgtcgtcccaccagtcggccgcgctgccgttgccggcgaggagatacaggatcggtttgctcatggaggcttcgtcggcgggcgatcgtcgcggtggcgcgcgcccggttggggcggcgcggcccgcggatgccgctgcgcatgttcgtgtcgtcttgttcgcgttgcgccggtgcgagtggaatggaagcgtggccccgctcggcttgatggttgcgcgcattctacttgagtcgacccggacgataaccgccatctcgaacgcgacttcatgcagacgcaggtgatgcatgacgtgtgcgggaatggccgatgccgtcaatgaatccggctcgtgatcgttcggcgcgaaggcttgtgcggcggccctttcaaccgcgcgcccatggcgcgttacgtgtcggattcggcgccggcgcgcggcgggtgcccggtccagcgtcgatacgcatggcggaagctgcgcggctcgctgtagccgagacgttccgcaatggccgcgaccgtcagctcgggatcgtcgagcatccgcaccgcctcgtcgcggcgcacgtcgtcgagcagcgactggaacgtgaggccgtccttgtcgagccgacggcgcagcgtgcgctccgtcaggtgcagcgcgttcgcgagcgacgtcatcgacttgaaacgcgtgaggtcgcgcgccatcagctccttcgtgcgatcggcgaaacgcgtgccgaccgacgcggcccactgccgctcgagcgcctcgcactggccgtgcagcgcattgaagctgacttcgttcgcgagcagcggcatctcggtgccgtccacggacgtgaacacgagccggttgtcaccggcattgaacgcgaccttgcagccgaagtggcgcgtgtagtcggccgcgttgcgcggcgtgcggcgcgcgagctgtacctgcgcgggccagaccggcttgccgacgaggtcggacacgatcaggcgcaggctcgacaggcacatgtcgacctggaacacctcgagatcgggctcgccgttgtagcggctgatggtcacgctcatgccgtccgcatgcgcatcgatacgcacgtcgaaatacaggcccatgaacagcggaaactggctcatgcaccggaatgcctgcatgacggagccgctgatcagcatcgcgtagccggcgaggccgagtgtcgatacgtgcagccgcgcgccgatcgacagcccgatcgacggcacgccgctgcgctgcagcaggttgcggaagcagcgctgctcctggccgcgattcacgtgcaggttcggcgacgcgacttcgtccgcgccgagccccgtgccttcgagcagcgcggcaccgtcgatgtgccgcacgcggcactcgtccagcgcgaccgcgatcgcgtggacggtggcggaatgtcctcctggcgtccggccgggcgcgcgaggccgagcgacgaacgcaggctgcgctcggcccggctctggtttcgatgagagcgggtgtccatggtgctgacggggcgactgggtcgcgtagaacatagccggaatgtccgcaaaacgccagtgcggcacagcaccatgcatgacgcgccgacgcgatacgcggccgggtgtccggaaatatccccgattacgtccgcatttctcattcgtggcggaatttttggcgcaccacactttcttccagtcgtgcgccgccggccgtgccgggcgaacgagtgttgaagccgtgaacgccacctacgtgaggacagcatggacaacgacagccccggtcgatacgcatcggccgccgcgacacaggacttcgcagcgcacgcgtttcgcagcgacgcggacgaccgccgcaaaccgcacctgctcggtctcgcgacgctggtgatcttcggcctcgcgtacatgctgccgatgacggtgttcacgacctacgggctcgtcacgagcgagacgaacgggcacctgacggccgcgtatgcggtcacgctggtcgcgatgctgttcaccgcgcgcagctatggccacatggcgcggctgatgccgagcgccgggtccgcctatacgttcgcgagccgcaatttcggcacgtcggccggcttcatggtcggctgggcgctgctgatggactacctgttcatcccgatgatcagctacctcgcgatcggcatctacatgaagcagatttttccgatggtgccggccagcgtgtggatcgtcgggagcatcgcgctgatcaccgggctgaacatcgtcggcatccgcctcgtcaatcgcgtgaacctgatcctcatcgcgagccagctcgtgttcatcgcgatcttcgtcatcgcatcggcgcgggtcgcggcaggcgaggggctgtcgatggccgtcgcgttgccgtcgtcgggcgatgcgcgcgcgatcttcgccgggtccgcgatcctgtgcctgtcgttcctcggcttcgacgcggtcaccacgctgtcggaggaaacgcgcgagccgaagcgcacggtgccgcgcgcgatcctgctctgcacgctggcgagcggcgtgctgttcatgctgatcgcgtatgtcgggcaggtggtgtttcccgactggcacgcattcaaggatctcgattcggccagcctcgagctgatgcggcgcatcggcggcggcacgctgtcggcgttcttcgtcgccgtgtacgtggccggctgtttcgcgagcgcgatggccgggcaggcgagcgtgacgcgcgtgctgttcgcgatgggccgcgaccgggtgctgcccgagcgcgtgttcggccacctgcatgcgcggctgcgcacgccggtgcgcgcgacgctcgcggtcggcgtcgtgtcgctgtccgcgctgttcgtcacgctcgatctcgcgtcgacgatgatcagcttcggcgcgctcgtcgcgttcgcggtcgtgaacctgtgcgtgatgcgcagttatctgtgccgcgccgagcatcgccgcttcgcggggtggatcacgttcggcgtgatgccggcgctcggcttcgcgatgaacgtgtggctctggtcggggctgtcgcgccagacgttctacgtcggcatcggctggctcgtgctcgggctctgccagctcgcatggctgacgcgcggcttcacgcgccccgcgccgacgctgtcgatgaactgaatgaccgggcgcgccgcgccggacctgaaaccctgaaggaggagtgaaccatgaacgctgttgacgtcaatctcgatgcggacctgcaggcgctcggcaagcgccacctgctgatgcatttcacgcacgccgatgcgtatcgcgaccatgcgctgaccgtgttcgaccgcggcgaaggctgctggctcgtcgaccgccacggcaagcgctacttcgatgcgctggccgggctgtactgcgtgcaggtcggctatagccacggcgcggaaatcggcgacgcgatccgcgagcagatggtgcggctgccgttcgccaccaactggggtgtcggccacgagccggcgatcacgctcgcgcacaagctcgcgacgctcgcgccggacgggctgaaccgcgtgttcttcacgtcgagcggctcggagtcaaacgaagcggcgatcaagctggtgcggcagtatcaccagtcgcgcggcgagccgcagcggcgcaagttcatcgcgcggcgcgtcgcgtatcacggcacgtcgttcggcgcgctcgcgctgaacgggatgacgaacttccgcaagcatttcgagccgctgatgtcgggcgtgcgacacgtgggcaacacgaaacgctacggccgcccggcgggcgagacggaagcgcagttcacgcgccatctgctcgacgagatcgagtcgctgatcgtgcaggaaggcccggataccgtcgccgcgatcgtcgtcgagccgttgcagaacgcgggcggcagcctgacgccgccggccggctacacggccgggctgcgcgacatctgcgaccggcacggcgtgctgctcgtcgccgacgaagtgatctgcgggttcggccggctcggcgaatatttcggctccgcgcgctacgggctgaagccggacatcatcacgttcgcgaaaggcatcgcgtcgggctacgtgccgctcggcggcgtgatcgcgagcgacgcggtcgtcgaaacgatcctcgacggcccgcagcagatgttcctgcacggtgcgacatacggcggccatccggtcgcgtgcacggccgcgctcgcgaacctcgcgatcatggagcgcgaaggcgtgctcgagaacgtccgacgcaacgaagcggtgttccgccagacccttgacggcctgctcgaactgccgtgcgtcggcgacgtgcgcggcgacggctaccactactcgctcgaactcgtgaccgacaaggccgcgcgccgctgggcggccggcatcagcgcgcaggcgttcgtgtcgacgctgctcgcgcccgcgatcttcgacgcggggctgctgtgccgcgcgggcgtcgatcacgaaggcacgccgatcgtgcagttctcgccgccgctcgtgatgtcacgtgacgaaatcgtgtggttcgtcgcgcagatccgcgacattctcgtcgacaccttcgcgcgcgcgacgcgctgagcgcgacaccggcatccatcaccacaggagcactcgatgcgaacctcacaacagtcctatatcgacggccagtggctcgacccggccgatgcgaaggcgatcgacgtgatcgacccgagcacggcgcggccgtatgcgcagctcaggatcggcggcgcggccgacgtcgaccgtgcggtgggcgcggcccggcgggccttcgacacgtattcgcactggccggtgagcgagcgcgtcgcgctgctgcggcgcgtgctcgagatctaccagcgccgctacgaggaggtcgcgcggacgatcagccaggagatgggcgcaccgatcgcattcgcgcgcgcgatgcaggcggcggtcggcaccgagcacctcgagcagacgatccgcgcgctgcagtcgttccgcttcagcacgcagaccgattcgctgctggtgtcgcacgagccgatcggcgtgtgcgcgctgatcacgccatggaactggccgatcaaccagatcgtgtgcaaggtcgcgccggcgctcgcggccggctgcacgatggtgctcaagccgagcgagatcgcgccgttcagcgcgatcctgttcgcggagatcctgcacgaagccggcgtgccgccgggcgtgttcaacctcgtgcacggttacgggcacgaagtgggcgacgcgctgtcgcggcatccggacgtcgacatggtgtcgttcaccggttcgacgcgcgcgggtgtcgaggtcgcgaaggcggccgccgataccgtgaagcgcgtgcaccaggaactcggcagcaagagcccgaacctgatcctgcccgatgccgacatcgaggatgcggtcacgcgcggtgcgcgcagttgcttcagcaacagcgggcagtcgtgcaacgcgccgacgcggatgttcgtgcatgtcgaccaccttgccgcagccgaggccgcggcgcgcaacgaggcggcgcgcaccgtcgtcggcgatccgcgttcgacggaaacgggtatcgggccggtcgtcagccgcacgcagttcgaccgcatccagcagctgatccagtgcgggatcgacgaaggcgcgacgctcgtcgccggtggcaccggtcggcccgacgggctcggagacggcttctacgtgaagccgacggtgttctcgaacgtcacgcccggcatgacgatcgcgcgcgaggaaatcttcgggccggtgctgtcgatcctgacctaccgcaccgaggacgaggcgatcgcgctcgcgaacgattcggtctacgggcttgcggcatacgtgcagacgaaggatctcgagcgcgcgcgccgggtcgcggcacggctgcgggtcggcaacgtgcacatcaactatccggcgtggaatccggccgcgccgttcggcggctacaagcgttcgggcaacggacgcgagtatgcggagttcggcctcgtcgaatatctggagacgaagggcacgacggggtacacggaaggcggcgtgcgctgacgatcccgatcgcccgggtacaccacgagacgaatacgttccggccggtgccgacgccgctcgcggcgttcggccgcaacggtgcgcaacggcgcgtcatcggcattcgcggcgcggtagggtattcaggccgccgcgaagcagtcggccttgaatcgaccgcgccggccgacgctcagtcctcttcgggatccgttgcggccgcatcgggtcccgcaatgtgagcggcagcccgcctgcggatctcggagtcgaggatcaggcgcccgcgcagcttgcctttcatccgcttcacatgcttggggcctcggtcatgtgctcgaccatcagcgcccgcacgcgctcggcatcgcgctcgcgagcggcctgcaggatcgccttgtggatcgacacgtttgcttcgccgaagcgcttgtgctcgacgagcggcgtgtcgttccggaactcgatcaactgccggatcatctcgttgatcagctcgcagctgaatcgcaggaacgggttcgggttcgcggctgcgaggatgtcgtggaacgtcgtgtcctcctgccgctggcgcagcatgtggccgcggtcgtgcatacccgagccgccatcacaacacgcgatgttcgcctccagcgccgcgaagtcgcgctcggtcaggtgcggcacggcgcccgccgccagctcgggttcgagcagttggcgcaccgtatagatgtcgtcgatcgtcacgtccttgaagaacaggtagttctgcagcagctgcagcgtgcggtcgagcggcacctcgacgaccatcccgccgcccgtcggccccgtcgtgaccttgatgagcccctgcacctcgagcgacttcagcgcctcgcggatcgtgctcttgctcaccgcatacaactgctgcagctccgcctcgcgcggcaggcggtcgcctggtttcagatccttctcggtgatcagccgcttgatctcctcggcgacgaggtcggcccgcttcggctgcttgatttcgaccgcgaggcccgccctggctcggtccatgaccatcttcaagactcctttgtctgactgcgcgccacgttcgtcggcgacgatccgttccggcgcggggtacggaattttgcctgattgacactaattttgatcaactatagcatcgggttcattctatttatcatgataaataggatcaaccggcggcgcgcatcctgcagggcgtgggcacggtttggcagtcggtcgcatcgcgtgtgtcccctttatcaggagcgtcaacttgaatcgccgagaactgttgaaactggccgcgctgtcggccgtgccgggtgcgctcggcagcatgtcgtcccgtgccgcgttcgcgcagggttcgcccatccagcttgcgtgcccggtgccgatgtcggggccgttcgccgccaacggcaagtacgccgatctcggcatgcagctcgtcgtcaagcagtacggcaaggtgcttggttcgccgcttgcctatacggcgctcgacacagagggcaagcccgcgaccgccgtgcggcgtgtgcaggagatcgcgcagcagaagggcgtgcgcttcttcgcgggcggcatcctgtcgtccgaatcgctggcgatgggcaaggaagtccagaaggcggacggcgtgttcatcacgacggccggcgcggacgaaatcaccggcaaggattgcaatgccgcgacgttccgctggtcggtgccgaccttcggcgcgatcgagcagacggtgcgcccgttgatccagatgctgccgaaggcgaagcgttggtacacgatcacgccgcaatacgtgttcggcgacggcttgctgtcggccgcgaaagcgatcttcaaggagaagggcatcgagcatgtgggcaacagctaccactcgctcgccgagaaggagttcagcggctacctgacgaacgcggcggccgcgcagccggacgtgctgctgatcctgaacttcggctcgcaatcgtccgacacgttgcgccaggccgtcagcttcgggatgaagcgcaactgcacgatcctgctcgcgtgggcatcgggcctggaacagttcgaggcgctcgggccggacatctgcgatggcgtgtatttcggcgcgcagtactggcacgggatcgattcgccgctgaaccgcgacctcgtgaaacgcacgaacgccgcattcaaagccaacccgaactacagccttgcgggttcgtacatctgctcgaagatcctgatcgacgcgatggtgaaggccggcagcgccgatccgaagaaggtgatcgcggcgatggaaggcatgaaatacgacggcctcaccggcccggaagaaatccgcaagggtgaccaccaggtgatgaagaactattacctgctgaagggcaagccgaagaaccggatgaagaatgccgacgattacgccgacatcgtcagctcgggccagtcgttcctgccggtcgacaagaccggctgcaagctggcttgacaccctgcgcgcgtccgcgtgcgccgtgcgccgcggacgtccatttccttcctttctgacacggaagccatgaacgtctatctgctgcagatcgtcaacggcatcggcgtgggcatgttgtatttcctgcttgccgtcggcctgtcgatcgtgttcggcctgctgcgcttcgtgaatttcgctcacggcgcgttctacctgctcggcgcatatctctgctaccaggcgctgcaatggtcggcgaatttctgggtcgcgctcgcggtcgtgccgctcgtcgtcggcgcgttcgcgtggatcgtcgagaagctcgtgctgcgtcacgtgtatgcgcaacagcacgaattccacatcctggcgacggtcgggctcgcgctcgtgctgcaggagtgcgcgatcctcgcatggggcccgctcggcgacaacgtgccgccgcccgacgcgctgaacggcgtcgtgatctggggcggcttcgtctacccgaaataccggctgttcgtgatcgggttcacggccgtgctcgccgcgttgctgtggtgggtgctcgaaggcacgcggctcggcagtacggtgcgcgcgggcagcgaatcgacggagatggtatcgctgctcggcatcaacgtgacgcgcgtgttcagcctcgtgttcgcgctcggcgcggcgacggcggcactcgcgggcgtgctcgccgcaccgatccgcggcgtcgatccgttcatgggcatcgaggcgctcggcgtcgcgttcgtcgtggtcgtggtcggcgggatggggaattttctcggagcgctcgtgggcgggttgctggtcggtatcgtgcagagcctgatgagcacgctgtggccggaaggcgcacggctgatgatctatgtcgcgatggcggccgtgctgctgttgcgtccgaacgggttgctggggagggccgcatgatcgaatcgtcgaaaccgctgccgtcgggagcggcagtctcgccgcgcgtgcctgcatggcgctctgcgttgcaacgcccggagggctggctcgcggtggccgtcgtgtgcgtgctgccggtcgcgctgagctcgggctcgctcgcgaccgaagtgctggtgttcgcgctcgccgcgctcggctgcaacctgctgctgggctatacggggctgttgtcattcgggcagggcatcttcttcgggctcggcagctacgcggcggggctggtgctgacgcacggcgtcgcatcggtgaccgctgcgctcgctgcagccaccgtgctcggagccgtcgcggcggcgctcgtcggctggttctcgatccggcagcgtggcacctacttcgtgatgctgacgctcgcgttcgggcagctgttctactttctcgcctacacgacgccggacgtcacgggcggcgacaacgggctgctcgacatcccgcgtcccgcgctcgccgcgttcgggcatccgctcgtttcactcgattcgccgtggcgctactacggcttcgtcgcggtgctgtttgtcgcggtgttctggctgctgttgcgcgtgtcgcgctccgtgttcggccgcacgctgctcgcgatccgcgacaacgaggcacgcgcggcagcggccggctacgacgtgaagcgcttcaagcttgcggcgttcgtgctttcggggcggtcacgggtttcgcgggtgcgctgcacgcgttgatgacgggcatcgcgccgctgtcgaacatcgactatcacacgagcgagatgatcctcgtgatgacggtgatcggcggcacgggcaacctgttcgcgtcggtgctcggcgcggcattctacgtgctgttcgcggactggctgtcgacgctgtggccgcgctggctgctgctgctcggcctcgtgctgatcgcggtcagcctgttcatgcagcgcgggttgtggggattgggtgaacgcgtcgtggcgtcgctgcggcgcggcggacgcacggcggtgacgaccgaggagcggcaatgagcgaagcgattctcgaagcgcgcggcattgtcaagcgctacggcaagttcacggcgctgggcggcgtcgatctgcggatcatgccgcgcaccgtgcattcggtgatcgggccgaacggcgccggcaagacgacactgttccatacgttgacgggcacgctgccgatcacgtcgggctcgatcctgttcgacggtcacgacgtgtcgcgcgaacccgatcacaagcgcgtgcggcgcggcatcgcgcgctcgttccaggtgacgagcctgtttccgaacctgagcgtgcgcgagaacctgcgcgttgccgcgcagggcgtcgaatcgcggcgcgcgctgaatccgtggacgccgccgcgcggtgcgcttgcgcacgacggcatcgtcgacgacgtgctcgagcggctcggcctgcagcgcttcgccgatacggcggccggcgtgctgtcgcacggccagcagcgccggctcgaggtcgggatggcgctggcggcgcgaccgcgcgcgatctttctcgacgagccgacgtcgggcatggggatcgacgatctcgacgacatgaaggcactgatccgcggcctgcgcgacgactacacggtcgtgctgatcgaacacaacatgggcatcgtgatggacatctcggacacgattacggtgatgcagcagggccgcgtgctggtcgaaggcaaaccggatgcgattcgcggcgacgagcgcgtgcgcagcgcgtatctcggcaacatgatcacgggaggccgcgcatgatgctcgacgtgaaggaggttcatgcgtactacggcaagagtcacgtgctgcagggcatttcgctgaacgtgaacgaaggcgagacggtgacgctgctggggcgcaacggtgcgggcaagtcgacgacgctcaagaccatcgccggtgtcgtggcaccaaccggtggcacggtgacgttcgtgggccgttcgctgtccgggcagcccgcacaccggatcgccacgcgcgggttgtgcttcgtgcccgagcatcgcgggattttccggctgctgtcggtcgaggaaaacctgctgctcggcgcgcgccgggattcgccgtggcagctcgacgacatctaccggatctttccgcgcctgaaggaacgccgccgcaacggcggcgcacagctgtcgggcggcgaacagcagatgctcgcgatcggacgcgcgctgatgaaccacccgcggctgctgatgcttgacgagccggtcgaggggctcgcgccggtgatcgtcgaggagatcgtcgcgcagttgaagcagatcaaggcggccggcgtcgcgatcctgctcgtcgaacagaacctcgaagtgtgcacgcagctcgcggaccgccacttcgtgatcgaacagggcgtgatcgtctatgaaggcagcaacgcggcgttcgcggccgatcacgaggtgaaggaccgttacctgggcgtcggcgtcgcgtaagcgtcgtgccctttcattgcgaggaatttcatcgatgcaagttcaggattcgacatcgggcgtcgcggcgtccggcttgcgcgttgacggcgcgaggctgtgggacagcctgatgcgtctcgcgcgaatcggcgcgaccgacaagggcggcgtatgccgcctcgcgctcaccgaactcgatcgcgaggcgcgcgacctgttcgtcgcatgggcgaaggaagccggctgtacggtgcgtgtcgatgcgatcggcaacatcttcgcgcggcgtgcgggcgaacgcgacgacctgccgcccgtggcgacgggcagccatatcgacacgcagccgaccggcggcaagttcgacggcaactacggcgtgctcgcgggcctcgaagtgctgcgcacactcgacgacgcgggcgtgcgcacgcgtgcgccgctcgaggtcgccgtctggaccaacgaggaaggctcgcgcttcgtgcccgtgatgatgggctccggcgtgttcgcgggcgcgttcacgctcgaccatgcgctcgcgcaatgcgaccgcgacggcgtgtcggtacgcgacgcgctggttgcgatcggctatgcgggcgatgcggacggcgggcacggcgcgcatccggtcggcgcgtatttcgaagcgcatatcgagcaggggccggtgctggaggcgcacgacacgacgatcggcgtggtcgagggcgcactcgggcagcgctggtacgacgtgaccgtgcacggcatggaggcgcacgcgggcccgacgccgatggcgttgcgacgcgacgcgctgctggtcgcggccgatctggtgcgcgcggtgaacgccattgcgctcgcgcatccgccgcacggacgcggcacggtcggctgggtcaacgtgcacccgaattcgcgcaacgtgattccgggccgcgtgacgctgaccgtcgacctgcgcgcggttgacgacgcgacgctgacggcgatggatgcgcaactgcgcgcggcgtgcgccgacctgggcgcagcggccgacatgcggatcgacgtcgagcaggtcgtgtattttccgccgcagccgttcgatgcgacgctggtcgagcaggttcgcgccggcgtgaacgcgctcgggctgtcgtcgatgaacgtgatcagcggtgcgggccacgacgctgtgtatctcgcgcgcgttgcaccgaccgcgatgatcttcgtgccgtgcaaggacgggatcagccacaacgagattgaggacgccgatccggcgcatctggaagccggctgcaacgtgctgctgcacgcgatgctgggcgctgccgggatcgcggaggactctgcgcgatgaagatcctgatcgcccggatgaaccacgagacgaacacgttctcgccggtgccgacgccgctcgccgcgttcggccgcaacggccccgactggggcgacgatgcgtatcgcgcgaatcgcgggatgcgcaccgcgatggccgcgttcctcgacgcggccgagcgtgaaggcgccgggatcgtcacgcccgtatcggcggccgcgaacccgagcgggccggtcgcggccgacgcgtatgcggcgatctgcgacgcgatcgtcgcggccgcgccgggttgcgatgccgtgatgctcgacctgcacggcgcgatggtcgccgagcagagcgcggacggcgagggcgacctgctcgaacgcgtgcgcgcggcgctgcccgatgcgccgatcgcggtcgcgctcgacctgcatgcgaacgtcacgcagaagatggtcgatcacgcggacgtgatcgtcagtttcaagacctatccgcacgtcgatatgtacgagacgggcgagcatgcggcgcgcgtgctgctcgatcgtctccacggtcgcacgcggcccgtgcttgcgtggcggcagccgccgctgatgacgtcgacgttgcgcagcgcgagcgcggaaggcgcgatgaagcgcgcggtggaggccgcgcgcgcggccgaggccgacgggatgcttgcggtatcggtgctgcccggtttctcgctcgcggacattcccgcgccgtgcatcagcgtcgtcgtcgtggccgatggcgaccgcgccgcggccgacgcggcggccgagcgcatcgcgcggcagatctgggacgcgcgcgacgcgttcgtctatcgcagcgcgccgctcgccgaatcggtcgcgcaggccgcggcgctcgcgcgtggcgcggatcgccccgtgctgatgctcgatcacggcgacaactgcatgtcgggcggcccgtgcgacacgatggacctgctcgaggccgcgctcgggcacgggctcgacggcatcgtcagcgggccgctgtgcgacccgcaggccgtcgccgcgctgatcgacgcgggcgtcggcgcgaccgtgacggtgccggtcggcaaccgcctgccgtcgcacggcggcgtgcggcgcgagccgtttcgcgcgaccggcattgtgcgtgcgctcaccgacggcgaatacgtgatcacggggccgacttacacgggccagcgcgcgtacatgggccgcacggccgtgctcgatatcggcgcggccacgctcgtcatcaccgagcgtacgcaggagccgtgggacctcggcgtgttcgagagcgtcggcgtcgatccgcgccgcgcacgcttcctgctgctgaaatcgcggatgtattgccggccggtgttcgtgccgatcgcggccgcgctggtcgagtgcgacagccgcggcgtgacgggctcggactacgggctgtttcactacgagcggctggcgcggccggtgtatccgctcgatgatgtcggcgagtggtcgtccggcgcgcgacggacgggttgaccgaaacgaaccgggtgcgggacgccggattcggcggctttcgggcatcatgcggtggtttcgacccgtcgagcagcagggtcgagccatccattgcatccgcaaccgatccggagaaccgaccgccatgcattcgaatcctttccgcccgcgcagcgcgcgcctgctcgccgcgctgacccttgccacgacggccgttgccgcgcacgccgccgactggatcgtgtccggcaacgacggcaagtaccagcgcgtcgagggccgcgatacctatctcgcttcgccgcccgccgacacgctgacgctgctcgacgccagcacgttcccgccgaaggtcgcgcggcaggtcgacgtcgagaacggcatccaggggccgccgcaggccgtcgcgatcacgcccgacgcgaagctcgcgcttgtcggcgcgccgacgcgctacgacacggccgcgaagcagctcgtgttcgacacgttcctgcaggtcgtgaatctcgacgacgcgccgccgtcggtcacgcgcatcgagctcggcacgcatccgcaggggatcgcgatcgaccgctcgggcaagctcgcgctcgtcgcgaacgtcgacggcagcgtgtcgatccttcgcatcgacggcacgcaggtgacgctcgacggcagcctgaagatcggcaagaagcggctggccgggatcagcttcacgcacgacggcaagcatgcgctcgtgtcgctacgcgacgagcagggcatcgcggtgctgaacgtcgacgacggcaaggtgaccgacagcgggtcgcgcctgagcacgggtgtcgcgccttacacgatcgacgtgtcgagcgacaaccgctgggccgtcgtcagcaacgtggggctggccgggctgccgggctatacgggcacgctcgcgggcgatgccgattcggtcgcgctgatcgacgtgtcgcgagtgccgttccgcacggtccagtacctgacggtgccgtcgctgccggaaggcgtcgcgatttcgccggacgggaagtggatcgccgtgcaggcgatggacggctcgaacctgacggccgacaatccgggccgccacaagatcggcaaggtgctgctgttcgaaatccgtgacgggcaggccgtgaaggtgagcgaggtgcccggcggcgaagccgcgcaaggcatcgtgttcaccgcggacagccggcacgtgatcgtgcagttcaacgtcgagcggcagctggcgttctatgcggtggaaggcggcaagctgcgcgatacgggcaagcggatcgcgctgacgggcggaccgtcgtcgctacggacgttgccgcgctgacgcgcacggcatccgttcgtcccgttcttcacgttcatgcggcgcccgggttcgccgggcgcctgtcaatgcacctcccggtgcgccgccgttgcaacgcaacaaatggcgggaatgcatacccgaagctgattaacttccgattgtttagttaaacaaactgaaaattcgggaaacttctcgtggtgaataaacagctgttacggcactgtaagcccctgggaaggatgtgacgttcccggagacagggtggtgaggcgacggttgcggcagcaacgatcgtcgcgggtattcgcatgtaacgagtcagcgtgacgtcgcctggagggccagtcgacgccacgccgcgcggcatcgacgtgccgcgcagggccgcaagccgcgcggcgtgccggatgagtacggcgccggaacaatcgttttgattaacggtactaaacgaaaaatgagacatccacgactcttgctcgtcgccgcgctgacttgcgcggcgcttgccgcgtgcggcggcgacgacgtgaacggtgttaagacggccagcaacggcgcgggagacacgccgtcgaccgtgccgccgacttcggaccctccgggccgtcgcagcccgatcagccggcgccgcccaggcgcaccaacatgcagctgacccggttcgtcaatccgctcatcggcacgcaggtcaactcggactcgggttacgcgggcaacgtgagcccgggcgcgatggtgccgttcgggatggtgaatttcgggcccaatacgccgcgctacaacttcaacggctcgggcggttacctgtcgacgggcggggcgggcggcacgatcgacttcttcagcgtgacgcacctgagcggtgtcgggtgcccggggcagggcacggtcgcgatgctgccagccgatgcggcgaaggcgatcgcgtcgggcggtcggccgaccggaatcgggtacagctatgcggatgaaacggccgaacccgggtactacaaggtccgcctcgcgaacggcatcgtcacggagctgagcgcgacggcgcgctccggcatcgcgcgcttcacgtacacggacaaggacaagggcttcttctcgatcgacgcgaagctgaacggcaacagcgattcgggcagcacgaaggtcaccgccagcaacgtcgcactggcgctcgcgagcgacggcaggtcgatgagcgggcaggccgtcgcgccggcgttctgcacgccgtacggcacggtgtggaacgcgcccgtgtatttctacgcgtccttcgacgccgctgcgcaagcaggcgggcacgtcggcggtgaataccgtcagcaacggcgcggcgacgctgcagttcgacctgaccgacaccgaccgcaccgtcaccgtgaaggtcggggtctcgtccgtcagtatccagaatgcgcaggccaacctgaaagccgaaggcgaaaagctcgcgttcgacgacgcgcgcaacaacgcgtccggcttgtggaacgaccggctcaacacgatccagatcgaccaggccgccgcgcccgcatcgctgaacgcgacgcagaaggcgaacctgacgaagttctacaccgcgctctatcgcgtgttcggcacgccgacgctctacagcgacacgaacggcgaattccgcagcatgcgccagccgaagaacgcgagcggcggctatccggcgtcggtcgaccagaccggcaccgtgccgcagcgcgcgacggcaaaggtcggcgactacgcattccggcgcaccgacggctcgcagggcggcgcgggcaaccactacacgggcttctcgctgtgggatacgtaccggtcgcagacgcagttgctggcgctgctcgcgccaaaggaaacgagcgacatgatgcagtcgctcgtggtcgacgggcttcagtgcggcgcgttcccgcactgggtcgacggcagcgacgattcgacgccgatggccggcgacaacgcgctgaacgtgatcgccggcgcgtacaagttcggcgcgaccgatttcgatctggtgtcggccgcgcggctgacgaagcagtcggtgttcgatccgtcgagcgcatgcaacgaccgcacgagcgcagcggggctcgccaacttcctgacggcccactacctgtcgcagggcgacgacggtcactcgtcttcggccaccatcgagcgcgtgctgagcgaccgttccgcagccgcgttcctgcaggcattgcccgccagcgtgctgaacgcgccgtcggtcggcgtgacgcccgacaacatcggcacgctgtacacgcgggccgggtggtggcgcaacatcttcgactacacgaacaaggtgatcgccgcgcgcaatgcgccgccggccggctcggcgccgggcacgctggggacgctcgtgcagggttcgttccatgaatcgaccgagccgaactacttctggaccttcgcgcaggactggagcgcgctgatcgacgcgatcggcggcaagcaggcggccgtcgcgcggctgaacacgctgtttgcgatcaccacgccgttctcgaccgtgccggcctccggcgacctgaacggcggcgaatcgtccaccggcctgtacatcggcaacgaaccgtcgttccagtcgccgtggggctacaactgggcggggcagccgagcggtgcgcagtacatcctgccgatcatcatgtcgaaggcgttcacgaccgcgcgcgacgggctgccgggcaacgacgacatgggggcgacgtcgagctggtacgtgtgggcggcactcggcatgttcccggtgattccgtcggaggcggggctcgcgctgtccacgccgcagttcagcgggatcaccgtctggttcggcaacggcaagacgctgcggctcgaaagcgacaagcaggtggcgatggacggtgcggggcacccgtcgtttgcgtatatccagtcgctgaaggtgaacggcgcggactacgcgggctcatggctgccgctgggcaagatcgccaatggcggcacgatgcgctacacgctgttggctgcgccgacgcaatgggcggccgccgacaacctgacgccgccgtccggaccgaacgcggactatacgcagatgacggccggcagtccgtcgacggtgatgcgcatgcgccgggccggcgcgcagtgaacgtgaccggcgcgcgcgcggcttcgcgccgcgcgcgcccgcgacgatgtcggcatcatcaggagacaaccacatgacgtcgaaagaacgccggaaattcctgtcgtatggcgccgcactggtcggcacgaactggctcgccggctgcggtggcgacatggatgcgcccgccggcgcgtccggcacgcccggcgccgacggccccgcgacggtcacgcccgtcgtgccgggcgaccccgaacacagcctgctggccgcgcaggatctcacgacgaactggacgttcgccccggcgagcagcctgccgggcgccggcggcgcgcaactgtcgggcgcggccggcgtgccgggcatggcgccggcgacggtgcccggcaccgtgctgaacagcatgatcgtcaacggcaagtatcccgacccgttctacggccgcatcgtcacggacaccattcccgacacgctgaaggacaccgactactggtaccggacgaccttcacggcgcccgcacggcagccagggcagcggctgtggctgcgcttcggcggcgtcaactactgcgccgaggtctggctgaacggcgcgcccgtcggccggctcgaaggcgcgttcaagcaggggacgttcgacatctcgaggctggtgccgcaagcgggcggcgcggccggtctcgcggtacgcgtcgtcaagccggatttctcggaagggccgctgctgccgagctacgcgagcggcgtcacgcgcggcgggcgcaacggcggcccgaccggtgtcacgctgaagaacgggccgaccttcttctgctcggcgggctgggactggctgccgacgatccccgatcgcgaactcggcatctggcagccagtggcatggttcacgaccggcacggtgcggatcgcggcgatcaacgtcgcgcacacgctgtccaccgacctgtcgcacgccgagttgcggctcgatctcgaactggacaacggctccggcgcggatctcgtcgcgaccgtcgtcggcaccgtcggcagcggcgcgccgtttcgccacgacatcgcgattcccgcatcgagcacgacgacgaaggtgtcgctcacgtcgtcggatatcgcggcgctgtcgatcaggcagccgagcctgtggtggccgaacgggtatggcgaaccgaacctctacgcggtgacggtcggcatcgaggtggcgcgcaggcgctcggacgagcgcacgctgaaggtcggcctgcgccgcatcgaatacgtgcgcgacatcggcatggggccgcagttgagcatcacggtcaacggcctgccgatcctcgtgatgggcggcaactgggggctcgacgaggcgctgaagcgcattccgcgcgaacggctgttcaaccaggtgcggctccatcgcgacgcgaacctcaacctgatccgcaactggaacgggcagagcacgagcgacgatttcttcgatgcgtgcgaccgctacgggatcctcgtctggcaggacttcttcttctcgaccgaaggcgacgggtcggggccggccaacgtgccgcgcgatctcgacaacatccgcgacgtgatcgtgcgcaaccgccatcgtccgtcgatcctgctctggtgcggcggcaacgaaggtgcgccgccgccggcactcgtcaaggggctcgacgcgctcgtcgccgaactcgacccgcagcgcctgtgcctcacgagttcggccggcgatacgggcgccggcgcggtgaacggctattcgtccggcggcccgtacaactgggcgtcgccgcaggcggcattcagccgcggctacggcacgacgtcgatcgcgtttcacaacgaggtcggctcgcattcgatcccgacgctcgaatgcgtcgaatcgatgctgccgcccggctcgtacgaatgcccggacgacttctgggccgaccgcgacatgaacggcaacggcgcgtactacccgtcggtcggcaagcagggcggcgccggctacatcgcgatgacggcgcagcgctacggcgcgatccgcaatctcgcggacttcgtgcgcaaggcgcagatgatgaactacgaatgcatccgctcgatctacgaggcgaacgcggccgtgatgatcggcccggtggccgggaagatcacgtcgccggccaccggcgtgatcatgtggatgacgaaccccgcgcagccgagcttcgtgtggcagatgtacagccacgacctcgacgcgcacgcgtcgttcttcgcggtgcggcacgggtgccgtcgcgtcaatgcgatcctcgatgcgaataccgccgacgtgacgatcgcgaatcacacggcggcggctgtcaccggccgcgtcgagatgcgcgtgtacaacctcgacggcacgtcgagcagccggaccgtcgcggacgtcggcggcgtcgcgaaggcatcctatcgcgtggtggcgaacctgaaggcggcgatggccgcggcgaagtcggacgcgtgcatcgtgtcgctcgtgctgaccgatgcgggcggcaatacgctcgcggagaacgtgtactggcgacagcgcgacggaggcgacaccgcgtacacgtcgctcgatacgatgccgggcgcggcggttgccatcggcgcggcatcggccgagaccgacgacacgacgacgcgcatcacggtcgacgtcgcgaacatcggcacgacgttcgcgttgatgacgcacttgcaggtattcgatccgtcgaccggtgcgcgcgtgctacccgcgttctacagcgacaactacctgaacctgatgccgggcgcgaaacggcagatcacgatcgatttgccgcatgcgagcggtgcgccggtgccgcgcgccgcgctgcgcgtcgacgggtggcggctcgaccgcccgaactgcaggctcgggctcggcggcgtgccggtcgtgttcaacgagcgcgcgctggcagtcgatccggcggtgccgacgttcggggcgtgctgacggcggcgtgggcttgggcgtgggcgcgacgccgtgcaagcggcagcggagccgttcgagcgccgcgtaaaggcacgcggcgttcgttgcatgcctgatcgccggcgagccgttacggcttgagaaacctgtcgagccagcgcggtgtcgccgcgcgatcgaagacgacgtgcaactcgggactgaacgcgccgtattcgagcccatggcgttgggcaagcagcgtcagggactgcggcgtgtgaaacgagatgtgcccgttgcgcggcacgcagtaccaccactgctcgatgccgcgctcgatgatctcccggctgatcagcgacgtctggaacagcagcgcgccgtcgcgtttccggtaacgcatgatctggtcgaagaggtcgaacggcgccggatgatgctcgaacacctcgaacgacaggatcgtgtcgaacgtgccttcgggcggaaccgggtgcgagaacggatcgtacgacgtcacgtccgtgaagccgcgcgacgccagtttccgttccagcaagcccagccccgagccgaaatcgagaatccggccttcccgcatttccgcgaaactggtgcagatcaggtcggcatgctgctgcggacggacctcgagatactcgggatcgtggcgcgcatagtcggcgttatagacatgctgcgcgaaatcgtcgtgggtccagctgtcgaacatgggcgcccacgtgaagccgcattgctcgcaagcatggtagtagaccggcacgcccgcaaacgggtcgactttcttcccggcaatgaagtcggcgccgcagcgcgagaaatcgaccagcccgcagatgggggcgcgggccgaacacaccttgcaggcgagggcggccgggtggcggttcgaaccatgattcaaattccgttctcctggttgccggcgaggcgtgcgcgtgacagacggtgcggaagaggctatcacagtcgcgccggccgtcgcgccggccgtcgcgaccgggcgcggccgcgtggccctgcgcgcttacggacgcagcaggtcgaatccgccgaacacgacgacaccgctcaacacgatcatcgcgacggagtgctggccgaagtagagaatcgcggcggcaagccacgtcgtgatgcagaaggcgccgatgcgggccatcgtgtgttcctcgaatgcgtgatgaagtgagcgcgcgccggacggcactcgccgcttgaagcggcgagcggggcacgcaggcgaacggaaaaagcgacccgcgcggccgcgaccgcggcgtcggcacgtgtcgcgtgccgcgcccggaagggcgggagtcgataccggcggcgttgcgcgctcgcgccccggggcagcgggcgcgcgacttccgccggcgaagccgcgattttatcagcgctgcggcgccgcgaatctggccctttcgcgacgaaaaccggcgatcttcagccaaatctgtcgggccccgatactcaagtttcgtgtgacgaatgccgtaaacgaattggaaggcaattcccccagccacgattcgtttaccgacacagggaccgacacgatgcagatcgatttctccacgaccacgcgcacctcgctggcggacgcgagcccgggcgcgaacgcttcgtcggccgcgcccgccgcgacgtcatccaccgatggcgcgacgaatgccgcgggcgcgacgggtacggcgagtacggcaggcacgtccggtgcgcagggttcgaccggtgccaccggcgaaacgctcggcgcatcgggcgcgtcgtccgacgatccggcggtcgcgcagctgaaagcgttgatcgaccggttgcagaagcagctggccacgatcgagcgccagatggcgagcgcggcgcagcgcgcgaaggacgacccggccgcggcggtcgaacagcagtcgctgagcgcggaagccggcgcgatcgcgggggcgctggcgaccgcgatcgcgcaactcgcggcggccgtcgagaagacgggcggctcgtcggcgggcgggctggtgtcgacgcaggcctgagcggatgcggccgcgtcggccgcacgcattacaatcgcaagcacgtctcctcgacaggacggcagaacgatgcatgcggaactcgacgacgacgacctcgtccgcttcgacgcgcaaggcggcacgccgctgccggcggccgacgcgcaaggatggctcgaacacgacggcgcgcgcatctggcacgcgtcgttcggccacggcccgccggtcgtgctgctgcacggcggcctcggccacggcggcaactggggcaaccaggtgccggcgctgctcgcggccggctaccgcgcgatcgtgatcgacagccgcggccacggccgcagcacgcgcgacgcgcaaccctattcctacgaacgcatggcgtcggacgtgctcgcggtgctcgatgcgctgcacgtcgaccgtgcgcgcttcgtcggctggagtgacggcgcgtgcatcgcgctcgtgctggccgatcgcgcgccggaacgcgcggccggcgtgttcttcttcgcatgcaacatggacccgggcggcacgaaggagatcgtgccgggcccgctgctcgaccgctgcttcgcgcggcatcgcaaggactatgcggcgctttccgcgacaccgggcgagttcgacgcattcgtcgcggccgtcagcgaaatgatgcgcacgcaaccggattacagcgcggaggatctcgcggcgatcgccgtgccggtcacgatcgtgctgggcgagcacgacgaattcatccggcccgagcatgcggcgtacctggcgcgcacgatcccgggcgcgacgctgacgatcctgcctggcgtgagccatttcgcgccgctgcagcggcccgcgcggttcaacgcggcgatgctggcgtttctggaccggttgccggggtgacgcgctcgagcctcgtgttgccggcgccgtgactcgcttgtacggcaacgtcaccgacgtgtcgcgttcgtggcagtgcacttgacggtgctgcccgacgttccccgcaaaccatcgagcacgccgcgacggcagcggtcatccacgccttcgccaatcccataagtttttctttaggctcgatcaacataacgtcgattgttgacggacggcttacagcggatagtcctgcttcggcaggccggccgctgcgatttccgtatggcgcgaccggatctgttgtccacgcaaccatcggaaatcgaaggaaccgcaaccatgcgattcaacgcgacacgcttcgccgcgaccctgttcgtcgccgcgtgcgtcaccgccacggccggccgcgcggccgccgccaccccggacgacctccacgacaccgtgacccgccacatcgcgccgctgatgaagcagtacgcgattcccggcatggcggtcggcatcgtcgccgacggcaagccctacgtgttcgactacggggtgatgtcgacgcaaaccggcaagcccgtcaccggcgacacgctgttcgaaatcggctcggtcagcaagacgctgaccgcgacgctcgcggccgacgcgcaggagggcggcgaactgtcgctggccgatccggtcggcaagtacctgcctgccctgcagggcaagccgttcggtgtcgtgacgctgctcgatctcggtacgcacacgtccggcggcatgccggtacaggtgccggacagcatccgcgacgacgcggggctgatccgctatctcgacgcgtggcggcccgcgcacgcgccgggtacgtaccggacgtattcgaacgtgtcggtcggcatgctcgggtggctcaccgcaaaggcgatgcacaaggatttcgcggtgctgatggagcagcggctctttcccgcgctcggcatgacgcacacgtacatcaacgtgccggaagcacgtcaggccgactacgcacagggttatacgcaggacggcaagccgatccggatgacgggcggcatgctgtggcagccggcctacggcgtgcggaccacggcggccgacctgctgcgcttcgtgcaggcgaacatggggctgatcgaaaccgcgccgcgcctgcagcgcgcgctcgaacgcacccacaccggctatttccgcgcggggccgctgacgcaggacctgatctgggaacagtatccgtatccggtcgcgctgccgacgctgctcgaaggcaactcgatgaagatgctgcgcgacgggttgccggcctccgcgatcaagccgccgctcgcgccgagcgcggatacgtggatcaacaagacgggctcgaccaacggcttcagcacctatgtcgcgttcgtcccgtcgaagcggatcgcgatcgtgatgctcgcgaaccgcagctttccgaacgaggaccgcgtgaaggccgcgtacgggattctcggggcgctcgacggccggcggtaacgtttcagccggcgggccggtcgtgccgcacggccggcgtgccgagctgtcgggaaggcgaccgatgcggtcgcgacgaacccggacgaacgatggcgcacggcggcgatgccgcgcggctggcggatcgccgacctgtcgtgcaatgccgcatcgatcgcgcccgcccgccgctcattcgggcggctgctcgtcgtacgcgacgaagatcttccgtgtgcgttcgacgacttcccacgtgccgcgaaaacccggcggaatcacgaaacgatggccggcgcgcagggtcttccggttgccttcgaggtcggtgatcaccgacgtgccttcgaggatctcgcagtattccgcttcggtgtacgcgacgtgccagcagccgggcgtgctttcccagatgccggtcgagaagcggccgcacggactcgcgaagccgggtgtgagcgtgtgcagcggatcgccggaaatcagtttctcgggcgatacgcggtactgcgtcggctcgccgctcggggcgaacgcgtcggtgatggaggaaacgtcgatcatgatgagcatgcttcgtcggggtggatggatcgggtgcgcgtgcggcgcgcccgtgcgaggcgatcgcgatgcgtggcctcgcgtccgacatcatcgcagatcgacgcgcctgtgcgggcagcggccggatcggacgccgggaatcccggcccgaagcagcgccgcgcgatcgcgcagccgcgacgaacgcttatgatgggcgatcgacgcggtcacgcgaacgcgatacacgaggagatccggttgggcatcacatgggacggcatcacgagcgccgacgtgctcggcgacgcgcaagtcgcgacccggcacgcgctggccgacgcggccaggaacggcgactgggcgacgatgctcgcactcgtcgcgaaggagcgtgcgctcgtcaacgcgacccggctcggcggcacgtcgcttcgtgcgccgctgcatcaggccgcccgcggcggcgcaccgaaggcggtcgccgccgaactgttgaggctcggtgcgtggcgcatgctgcgcgatgcccgcggcgagcgcccggtcgatatcgccgggcggcgcgggcatcggcatctggtcgacctgctggcgccgcagccgcgacgcttcgtgcccgacgccacgctgttcgccatccagcgccatttccacgcgatgatgctcggccgcatcgcacatttgcgtgtcgacgcgctgcgcctgcccgagctcgagccgctactcgaactcgacgcgcaggccgaacgcatgtggttcgcggtgccgggcatgtatggcggattcggctacgcgctgcacacggacggcgatgcggcgatgctcgtgtccgaaagctggagccgcgtggccggcggctcgggccagcggcacgagatcaccgcggacggctgcacgctggtcgacgaggggttcgtctgacgcggccgatcatcccgttgcgctcaaaactgttttcgcgacgccgcccttcctcgcgcaacgccggccaccgatactgcgtcgcacgacatttcgcgagacgtctgccgtaccggctgtctcgctctcggagcagcagatgaaagggatcaggatattcgtgacgggcgcgagcggctacatcggcggctcggtggccgcgcggctcgtctcggcaggacacgtcgtcaccggcttgacgcgcgacggcgacaacgccgcgaaactcgcggcggccggcatcatgccggtcgtcggcacgctcgacgactcggcgctgctgcaagcgttcgcgcgcgacgcggactgcgtcgtcaacgcggcgagcagcgatcaccgcgaggcggtcgaggcgatcatcggcgcgctgagcggctcgggcaagacgttcgtgcatacgagcggcaccagcgtgatcgcggacgacgcacagggcgcgcatggcgatgccccgtattcgacgagacgacgcccgtcgtcaaacccgcgaaggccgagcgccgcgcgatcgaccggctcgtgatgtcgtcggccagcctcggcatccgctcggccgtgatctgcaacagcatgatctacggcgacggcctcggcatccgccgcgacagcgcgcaactgccgctgctcgcggcgatcgcgcgcgatgccggcgcggtgcgcgtgatcggcaaggggctgaaccgctggtcgaacgtgcacgtcgacgatgtcgccgatctgtatttgcgcgcgatcgatgccgcgccgcccggtgcgttctacttcgcggaaaacggcgaagcgtcgttcgcggaaatcggccatgcgctcggcgagcggctcggtttgccgtccatcgtcgaatgggacatcgcggatgcggcgcaggcgctcggccattcgcgtgcgcatgactcgctcgcgtcgaacagccgcgtgaaggcgctgcgcgcgcggcaggaactcgggtgggcgccgacgcacggagcgatgctcgactggattcgcggcgagatgcccgtcgcggtctgacacggcgttgccttgtctgacgaaagcgcgcccgcccgggcgcgtttgcgtatgcggcctcctgcttcatgccggattgttcggaccatattcgccgcgaatcattgaatcgaaatcaactgtgattcgcgcgcgcgccggcttatcaaagcggcgcggcggcactatcgtggcggtttctgaaactgcggaagactgccgaccatgaagacgaccctcgacgagatgctcgcgttcgtgaccatcgccgataccggttcgctgacgggtgcggccgacaagctgcaccagccgacctcggtaatgagccggatcctgcggcgcctcgaggagaagctcgacacgacgctgatccgccgcacgacgcgccgcctcgaattgaccgacgagggcaagctctttctcgactacgcgcgcgacatcatcgcgtcggtcgaatttgccgaggaacagatcgtcagccagcgcgagacgccgtccgggcgcttgcggatcaacgcggcgatgccgttcatgcagcacgtgatcgcgccgatgatgcccggcttccgcgaagcctatccggcgatcacggccgaactccatacgagcgacgagatcatcgacctgctcgaacagcgcaccgacgtggcgatccggatcggcgagctgcgcgattcgacgctgcatgcgcgccggctcggcagcagccggctgcgcatcctggcgagcccggcctatctggagaaagccggcgtgccgatgagcgtcgccgatctcgcgaaccatgcgctgctcggtttcgtgcagccggaaacgctgaaccactggccgttgcacaccgccgacggcggcgtgtaccgaattcatcctgcgctgcaggcgtcgagcggcgagacgctgctgacgctcgcgctcagtggcgccggcatcgtgtgcctggccgactacatgacgggcacgcatcgccgcgacggcagcctcgtcgagctgctcgtcgacgataccgtcgagttccgccagccgattcacgcggtgttctatcggaacgcgacgttgtcgtcgcgcatcgtcagttttctcgactacttgagcgcgcagttgaaggaaggcggcgacatcgactgagccggtaccgcacgcagccggccaagcaacatgcaaagggcggcgggttcgaatcacatcgaacccgccgccctttgcgtatcgaccgatgcgcggcagcggtcgaacctgaaccgcgcgcttactgccccagcgcagtcatcagcctgacccggccgagcatttcctcggtgcgtgcctgcgcgagcgaatcctcggccgcgagcagcgaacgctgcacctccagcgtatcgatgaacgccgattcgccgctgcgccacgaccggttgatctgcgtataggcgccgcgcgcgttcgacaccgcgcgttcgaggcgctcggtccggctgtgatcgcgggcggtggcggcgatcgacgtctcgacgtcgccgacggccgtcagcaccgtcgagcgatacgcggcgaccgcctgcgcggcctgcgcgcggcgcaacgcgacgacgctgcgccggcgcccgccgtcgaacagcggcgcgctcgcgccggcgccggccatccaggcgagcgaacgcgcgagcgtcgcgcccgaaagccgtcgatcgccgcaccgagcacgccgatcagttgcaggtgcggcttcaggtcggcctccgccacgccgatccgtgcataggcggcgacgacgcgcgcctcggccgcgcgcacgtcgggccggcggcgcagcaagtcggccggcgtgccgacgcccggcgcggcggccgtccacaccggttccggcgcgggcggatcgacgcgcgcgtagatggcctgcggcgtggatgcggtgatgatcgacagccggtggatcgcggcctgccgctgaagttgcagcgcgggcagctcggccagcgtcgtttccgtctgcgcggcggcgcggtccacgtcggccaccggcacgacgcccgcgtcgaacaggcgccgcgtcgattcctcggtgctgcgctggctcgacgcgttggcctcgaccagcgcgagccgctgctcgagcccgcgcaccgtcacgtaggtgcgcacggtttcgtcgatcgtcgcgatccgcacggccgccgcatcgttctgcgcggacgcgatatccgcgtcggcggccgacacgccctggcggatgcgcccgaagatgtcgatttcccacgcgaggctcgcattcaggtcgaacgcgttgccggtcgtcggcgtatcggtcgggaatgcctgcgacgcggagagccgctggcggccggcgcccgcgttcaggtcgaccgaagggaaccactgcgacgccgcgccgatccgcaccgcgcgcgccgcgtcgatgcgtgcgacggcggcctgcaggtcgaggttgttcgcgagcgccgtgtcgaccagcccgtcgaggatcgggtcgtggaaagcgtgccaccacgcgccggtgtcggcggccgggccgccggccgcgagatccgcgttcgcataggtcgcggccagcggcggcggcgtgacggtggcgaccggcgcgctcgtgcacgcggtcaggacggccgccgcggacagcgcggccacgagtcgaacgaacttcattgcaccacctccgtcgcgacggtcgcgacagcggccttgcgcaacgcgagccggcgaaccatcacatagaacacgggcgtaaacagcagcccgaagaacgtcacgccgatcatcccgaagaacacggccgcgccgacggcctggcgcatctccgcgccggcgccgtcggagatcacgagcggcagcacgccgaggatgaacgcaagcgacgtcatcacgatcgggcgcagccgctgcacgcaggcttcgacgacggcctcgacgagttcggtgccgtcggcctccagctgccgcgcgacctcgacgatcaggatcgcgttcttcgcggcgagcccgaccagcacgatgaagccgatctgcgtgaggatgttcacgtcctggccgagcgcgcgcacgccgagcgatgcggcgagcaggcacatcggcacgatcagcaggatcgacacgggcaggctccagctgccgtactgcgcggcgagcaccaggtagacgagcagcacgcacagcgggaacacgagcagccccgtgttgccggccgtggtctgctgatacgacagatcggtccattcgaacgaaatgccgggcggcagcacctgtttcgcgagcgattccatcgtcttgatcgcgaagccggaaccgaggcccggtgccgtatcgccgttgatctcggtggccggatacaggttgtagcgcggcgcgcgatcgacgccgagcgtgtcgtcgatgcgcgtgacgctgccgatcggcaccatctcgccgtcgcggttgcgcaccttcagccgcgcgagatcggaagcgccgacgcggaacggcaggtcggcctgcgcggtcacgcgataggtgcgcccgacgatgttgaagtcgttgatgtaggtcgagccgaaatacgtctcgaccgcgtcgttgatggcctggctcggcacgccgagcatctcggccttctcgcggtcgagctcgacgtgcacctgcgggctcgtcgcggagtagggcgtatagacgccgaccatgccgggcgtgcggttcgcggccgccaccagatcctgcgtcgccttcgcgagcgcggcggtgccgaggccgttgcggtcttcgagccgcatcgcgaaaccgcccgtgctgccgaggccctgcaccggcggcggcatcgcgacgacgatcgacgcctcggtgacggccgcgagccgcttgcgcatctcggcggcgatcgtgtcgatcgtcaggccgcgcgccttgcgttcgggccaggactggaacaccgggaacagaccggcgctgttcgccgagttcgtgccggtcgccgcgttcacgccggagaacaccggcacgcgtgcgacaccgggcaccgacagcgcgatgtcctcgatcttgcgtgcgacggcgctcgtgcgttcgagcgtcgcgccgtcgggcatccgcacgagcacgacgaggtagccgcggtcctgcgcgggaatgaagcccttcgggctcgacacgagcaggtagccggtcgcggcgatcagcaccacgtacagcacgcccatcgccgggatgatccgcacgaccttcctgacgagccggccatacgcatcggacagccgctggaacacgcggttgaacgcgttcgagaagcgccgcgcgacgcgcatcgccggcgcgaacggcgcggccatgcgcgatgccggtgcgggcacgtcgtgatcgcgggcgtgcgctttcagcatcatcgcggagagtgcgggcgcgagcgtcaccgacgtgaagaacgagatcgcggtcgacacggcgatcgtcacgccgaactggcggaagaactggcccgagatgcccggaatgaacgaggtcggcacgaacaccgcgcacagcacgagcgtgatcgcgaacagcgcgccgccgacttccttcatcgtcagcagtgttgcgtcgcgcggcccggcgccggccgacaggtgccgctcgacgttttcgaccacgacgatcgcgttgtcgacgacgatccccaccgcgagcacgaggccgaacagcgtcaggttgttgatcgagtagccgagcgcggccattgccgcgaacgtgccgacgagcgacaccggaatcgacaggatcgggatgatcgacggccgccagccctgcaggaacagcagcacgacgaacacgacgagcacgacggcttcgtagatggtcttgacgagttcgtggatgctgtcgccgatgaaggcggtcgggttgtagccgatgttgtagacgatgcccttcgggaagtccctggccagttcggccatcttcttctcgaccgcatccatcgtcgcgaccgcgttcgcgccgggctgctgcagcacctgcaacgcgatcgtcgggtggcgcagcatgtagctgtcggtcgcatacgcgagtgcgccgacctcgacgcgcgcgacatccttcagccgcacgagccgcccgtccttgccttgcttgacgacgatgtcgctgaaatcctcgggacgcttgagccgcccttcgaagatcaggttcggctggaacgcctggttcgtgatcggcgcctgcgcgaccacgccgcccgcgagctgcgtgttctgcgcacgcaccgcggcgatcaggtcgccggggctcaggccgaacgacgcgacgcgctcgggatcgagccagatgcgcatcgagtattcgcgcgcgccgagcgggttgatgtcgccgacgccctcgatccgcttcagcacgtccgcgacgttgcggatcgcgtagttcgacacgtacagcggatcgtagcgctggtccggcgagtacaggaagatcgtgccgagctgcgtcggcgacgacttgcgcaccgatacgccgctgcgctgcacgggctcgggcaggcgcggcgtcgcgagcgcgacgcggttctgcacgagcacctgcgccttgtcgacgtcggtgccgggcttgaacgtcacggtgatgttcaggctgccgtcggacgtcgcctggctgtacatgtacagcatgtcttccacgccgttcacttcgagttcgatcggcgtcgacaccgtttgcgacaccgtttccgcggacgcgcccggataggtcgcctggatcacgacggtcggcggcgcgatgtccggatactcggacaccgcgagcgagaaataggccagcgcaccggcgatggtcagcacgatggacaggacgatcgcgagcaccggttgctggacggacagacggccgaggttcattgcgcgctcccggtcgtgccgctcgccgcgcgggccaacgtggcggcttcgatcgcgcgcggcacggccttgaccttgtcgccggcctgcacgcgctggaagccgtcgacgatcacgcggtcgcccgcgttcagccccgcgtcgatctcgcgcaggttgccgtacaggcggccgggcgtcacggggcgaatcgcgacggtgccgttcgcgtcgacgaaatacagcacgcggcgcgtcgcatcggtcgcgacggccgcatccggcacgagcagcgcgtgatgcgcgacgcggctcgacagatagacgcggccgaactggccggggctcaggcgccggtcggattcgcgacgcgcgcgcgttgccgcagcgtgccggtcgagtcgtcgaggcggttgtcgacgaaatccatcgtgcccgtcagcgacggctgcgcatcgcccggcagcgcgatcgcgacctgccgcgacgacgcgctgccgccgctttttgcgcctcgcgcgtatagcgcaggtagcttgcctcgtcgacatcgaagtagatgtcgatcgggtcctgcgacacgatcgtcgtcagcacggtcgcgtcgctgtcgccgcctttcacgaggttgccctcgctgacgcgcttgcggctgatgcggccggacatcggcgcgacgatgcgcgtgaacgacaggtcgagccgcgcgcgttcgagcgcaccttgcgcgctcgtcacctcggcctgcgcactttgcacggcctgcctgcgctggtcgtagaggctctgcgcgatcgtgtcggtcctgatcaggatgctggcgcgttcgaaatcctgccggctcagcttcagttgcgactgcgcgcgttcgagcgtgccttgtgcggccgtgacggccgcttgatacgggcgcgggtcgatgacgaacagcaggtcgcccttgcgcacggtcgcgccgtcctggaacgcgaccttgtcgagataaccgctcacgcgcgggcgcacgtcgacggtgtcgaccgcttcgaagcggcccgtatagacgtcgacgtcgttgacgtcgcgcgcgacgggcgcgctgacgatcacgctcggcgtcgcggccggcgccttgtcgtccgaccggcagccggacaacgcgacgagcgcggccagtggaatggcggccagcacggccggccgcgcgatgcgcttcaatcctggatatcggttcatacgtgtgtgcgaaatatcgagttgggcgcctggcgccggatggtgcgcagtatccggcgcggcgcgcggcggataaacggatgaagcggcataagaacttgtactgcgcagtcacgaatcggcgtacgcggtgacgatgtgcgagcgggtttcgcggggcaggggagaaaaatgcggcgacgacgcgcggcccgaatgcctgttcaggcgattcgggccggccatgcggaagggcgggacgagcggtggcgcgtatcgggaggcgggcgctcttgcgcgtcggcgcggctcaatgaccgcgatagatcgagtcgcggccgttgatcgtcgtcacgcggccggattcgccggcggtgcgggcttcgctgccgtaaccggacgtcgcggcggccggtgcggtgcccggcgcgttttgtgcgacggtgttttcccgcacgcgcttttcggcggcgaggatcgcgaccggatactggttgtggtccagcgccggggtgtagccgacggccgcgaggcgcgccatttcggccttcacttcggcgcgggtcagttgatggtcggcctgctgcgcgaacgacagcgccggtgcggaaaggatcagtgcggcaagcgtggaagaaatcagcgttttcatcatgggtacctgtcgggtcgagtgaaccgcaaccacgtcgatgtcgttgcgagtgcagccaatataggtatcgcggcgcccgggaaaaacggctgccggcccaaatgatttttgatctggaatcacgaatcgggtgtggattcggtcgaaagccttgccggtcgggcgtcctgccggaacggggtatcggtgcggggcatcgaggcaggccttgaaacggccattcagacctccggggactcaagtgtgtcgaattccgtcttggacagacttaaccgacgtacctagactgaacccgctttccctcattccctggagaaaatcatgagtctcaaagacaagctgcccggtaacaagatccttggtttcggtacggccccgctcggcaacatgttccgcaacatccccgacgcggaagccgcggcgaccgtcgaagcggcatggcaacacggcatccgttatttcgattcggctccgttctacggcgcggggctggcggaaatccgcctcggcgatgcgctggcgaaccacccgcgcgacgaatatgtcctgagcaccaaggtcggccgcgtgatcctcgacgaaatcgaagacgtgtcggcgcgcgatctcggcgaaaagggcggcctgttcgaacacggccggccgaaccgcatcgtcaacgactacacggccgacgcgacgctgcgttcgatcgaggacagcctgaagcgcctgcgcaccgaccgcctcgacatcgtctgggtgcacgacatcgcgcaggacttctacggcgacgaatggctcgcgcagttcgaggtcgcgcgcaagggcgcgttccgcgtgctgggcaagctgcgcgaagaaggcgtgatcaaggcatggggctcggcgtgaaccgcgtcgagccgatcgaactggtgctggacctcgccgaaccgcaaccggacggcatgctgctggccggccgctacacgctgctcgaccacgagcgcgcgctgcaacgcgtgatgccggcggctgccgcgcagaacgtcgggatcgtcgtcggcggcccgtacagctcgggcgtgctcgcgggcggcacgcacttcgaataccagaaggcttcgccggacatcctcgcgaaggtcgagcggatcaaggcgatcgccacgcgctacgacgtgccgatcaaggccgccgcgctgcagttctcgatgtcgcatccggccaccgtcgcggtgattccgggcgcgagccgcccggagcggatcgcggaagaccaggcagcgctgaacgtggtgatcccggccgacttctggcgcgaaatgcgtgagcaaggtctgatcgcggccaacgcgccgctgccgaccggtcgttgatcctgacgtcaatcctgaaaggtgatgacatggcacaggccaatgcaaggatcgaactcccggcttcggccgggacggtctggcaactgatcggcggcttcgggtcgctgcccgactggctgtcgtacattccggccagcgaactgagcgaaggcgggcgcgtgcggcgtctcgcgaacccggccggcgaggcgatcgtcgagcggctggtcgcgttcgacgaagcgcaacgcagctacacgtacgcgatcctcgaagcgccgttcccggtcgtgaactatcgctccacgctgcgcgtgcgcgaaaacggcccgaacgcgtcgaccgtcgaatggtcgggcacgttcacgccgcacggcgcgaccgacgacgacaccgtcaagctgttccgcgggatctacgaagagggcctcgcggaactggcgaagcggttcgcggcggcctgacggcagcgcgactcgacgcatcgcatcgcatcgcgtgagcaggagcccggcgatatcgggctccgtcagcgccttcgtcgcgggttcaggctcttgccgaaggcgttgccatgtttgcttcgcatgcgcgaccgcaccgatgtgcaggcccccggccatccgcagcgttactttccggccaccgcgacgacctcttcgccggtcaggatttcgcggaagatgccgaccagcggccgcaggttgaccttgtgccacgcggcccacagcggcgtgcggtaactgaaccacggcagctcgcgcagcacgacgccttccggcacctggtgacgcaggctctgctggatcatcgtcacgccgagcccggcggcgacgaggccgagcgccgcgagcggctcggtcgcttccaccgaaatgtccggcgaaaagccggctttcgcgcacgccgcgacgaacgcgccgtgacgcggcgcgctttcgtgctgcgtcacgccgatccacgcctgcgcggcgagatcgtcggcgacgagcgtcttcttcttcgcgagcgggtgcccgtcgggcatcgcgagcagcatcggatcgttcagcacccgcatcgaatcgagttcggggtcgtcaggtgcaggcggctcggtgacgagcgcgatgtcgaggctgcgttcgcgcaagccttcgagctgtgcggcggattgatagttatacagagcgatgtgaacggacgggcgatcggcacgcagcgtcttcagcgcgcgcggcagcacgcccgagtgcgtggccgtttcgaggtagccgatgcacaggccgccttcgtcgccgcggccgagccggcgcgcgagcgattcgagccggttcgcgtgacgcaggaacgcgtgcgtttcgctgaggaacgtgcggccgtcacgcgtcagacgaatgcgctgctggctgcgttcgaacagcgtcagcccgagcttttcctcgagctgcgcgatctggcggctgagcggcgattgcgaaatgtgcaggcgttcggccgcgcggccgacgtgttcctcttccgcgaccgcgatgaaatactgaagctggcggatgtcgagcatataagaccttcggggactcaagtttgacgaattatgtcttggacagacttatgtgtgcaacctagactgggttcactttcctgtcagacccggagcaactgatgagtctcaaagacacgctgccggccgacaaccggctcggtttcggcgcggcgccgctcggcaacatgttccgcgacattcccgacgaagaagcgatcgccaccgtcgaagccgcgtgggcgcgcggtatccgctacttcgataccgctccgtcgtacggcgccggcctggccgaatcacgcctcggcgacgcgctcgccggccatcgccgtgacgactacgtcatcagcacgaaggtcggccgcgtcgtgctcgacgaaatggaagacgcgaagacgcgcgactacggcgaaaagagcgggatcttcgcgcatggccgcgcgaaccggctggtgagcgactactcggccgacgcgacgctgcgctcgatcgaggacagcctgaagcgcctgcgcactgaccgcctcgacatcgtctgggtgcacgacatcgcgcaggacatccatggcgacgaatggctcgcgcagttcgaggccgcgcgcaagggcgcgttccgcgtgctgggcaagctgcgcgaagaaggcgtgatcggtgcgtggggcctcggcgtgaaccgcgtcgagccgatcgaactggtgctggatctggccgaaccgcaaccggacggcatgctgctggccggccgctacacgctgctcgatcacgaacgcgcgctgcagcgcgtgatgccggcggctgcggcccgcaacgtcgggatcgtcgtcggcggcccgtacagttctggggtgctcgtcggcggcgcgcacttcgaatatcagaaggcgccgcccgacatcgttgcgaaggtcgagcgcatccgcgcgatcgcggtgcgctacgacgtgccggtcaaggcggccgcgctgcagttcgtgctcgcgcatccggcgacggccgcggtgattccgggcgcgagccggcccgagcggatcgcggaagattcagcggcactgacgttcgatatccccgccgatttctggcgcgagatgcgcgagcagcagctcgtcgcggccgatgcgccgctgccgatcgatcgctgagcgccgggcggcgcgcgatcgttcaggcgacggccgtgtcggccgcatcgactgctgcgggcgctgccgccgccgcgcccgccagccgccggtaacgcgcgagcgcccacagcgggaagtacgcggtatagccgtgatacttcaggtagaagatgcgcgggaagccgggcgcattgtgggaacgatgccaccagaaaccgtcttcctgctgcaccgactgcagatacgcgatgccgcgcctcaccgaatcggattcgcagtcgccgaacgccatctgcgcgagcagcgcccgcggtgaagttcgacgtgctctcgccgccattggtgccgcccagcttcgggtcgatatagctgtcgttcgtctcgccccagccgccatccgcatgctgccttgaacgcagccattcgatcgcgcgtgcgatatacggctgcgatttgtcctcgccggcgagcgcgaggccggccagcacgctccacgtaccgtagatgtagttcgtgccccagcggccccaccagctgccgtcgggctgctgcgtgcgcttcacgtattcgatgcagcgcgcgagcgacgcgcgttcgtccgcgcgtttcgtcacgccgaagcacagcagcacgcggcccgacacgtcctcggtcggcggatcgagcagggcgccgtgatcggcgaacgggatcgcgttcaggtacatgcggtcgcagtcggcgtcgaacgccgcgaagccgccgttgcgcgattgcagcccgcgcatccagtcgagcgcgcgcgcgacgcgcggcgcatacgggttcgtgccgtccgcgttgcaatgcgtgcggccgcggcgatcgagcattgcggtgacgaccgcggtgtcgtcgatgtcggggtagtacgggttcgcgtactggaacgcccatccgcccggctggacgtcggccggcgcgttctcgatccagtcgccgcgcaggtcgttcacctggcgttcggccagccagtcgtacgcgcgcgcgatgcgtgcgtcgagtgcgcgccgcgcgtcgtccggctcgccgtcttccggcaccgatacgccgcgcgcctgctcgagcgccatcgtgctccacgcggtatcccacaccggcgacaggcacggctggcaatacatgctgccgtccggccgcgtgaccagcagcttttccagcgcgttctcgcaatcgcgccgcagcggatgatcgtccgggtagccgagcacctgcatcatctggtagctgtacacgatcggcgggaagatcccgccgagcccgtcctcgccgttcatgcgctccgcgcaccacgcttcggcgtggcggatcgcgcgctgccgcaggcccttcggcatcagcggctcgacatgacgcaccgtgcggtcgagcgcgaggaacagcttgcgcatgccgcgcgcgggcgggaagtaccggcgttcttcatccggcggcgtgacgaacagctcacggatcgagacgttgcgcggattgcgggcgcgcgccttcagcgagcacagcacgagcagcggcaccatcgtcgtgcgcgcccagtacgcgaccttgtacatcgagatcggcacccacttcgggaacagcacgaattcgatcggcatgaacggcgccgcgcgccacggcacctggccgaacgtcgcgagcaggatgcgcgtgaacacattcgagcgtgccgcgccgccgagcttcaggatcgcgtcgcgcgcgcgaaccatgtgcggcgcgtgctcgctgtcgccggccgccttcagcgcgaagtacgccttcacgctgcacgacacgtccggatcgccgtcgacgtacagtgcccagccgccatgcgtgtcgagccgctggttcgcgcgcaggtagcgcgccatccgctcctggcggaggtcgtcgatcttgtccatgaaatgcatcatcaggatgtattccgcggtgatcgtcgcgtcggattcgagttcgaaacaccagctgccgtcgggctgctggagacgcacgagggcgtcgcgtccacgggcgatggcggtgtcgagcgcggaccaggggagggtggatcgagtcatgcggcggatcataccatccagccggaatgtttatatcgagacgcccggtgctaacatccgcatcatgaaaaagcacctcgaacccgcgccgcacgatgtggccgagcctgtcgaaccggctgccgtggccggtgcgcgggcgcctgaagcatcgtcggtgccggccgtcgccaccgccggcgtgcgtcggaaaaagcaccggaccaggtgcgcgcgcagctgctggcggccgcatcggaaatcgcgacacatcatggcgtggccgcattgacgctcgatgcggtggccgagcgcgccggcgtgacgaagggcgcgttgcagtatcacttcgcgaacaagcaggggctgctggatgcgctgttcggtcaagccaccgggcggttcgccgcgcagatggccgagcgggtggcggcggatgccggcggcgccggtgcggcggcgcgggcctacatgcacgcggtgctcgacgagtcgcagccggtcgcgagtaccgatgtgctgcgcgtgctcgtcgcgtcgatgattaccgaccaggacacgcgcgaacgatggtcggtgccgatgcgggaatggacgcgccccgacccggtgccgctcgagcaggccgcgacgctgatgatctgccggctcgccgccgacgggctatggatttcgcagttgctcgacagcgtcgagatctccgccgaattgcgcgcggaaatcgagcggcaactcgacgcgatgagccatggcgcgtttccgaaggggcgcgacggggccgcgtgacgcgtgacgcatgcgccgcggcgtcaggccgcgttcgcgcaccggcccggcggcgcgatcagaactgcgcctgcagcgtgaccgccctggcatcgcgccagacggtcagcggcaccacggtgcccttggcggtcgcatgcacggcgtcggccagatcggccatcgtcttgagcgggcgatcgccgaaccggatcagcacatcgtagttcttcaggccggcgcgatcggcgacggtgccgggcagcacaccgaggatctgcatcgcgccgccggggagcttcatgcccgcctgtacccgctcgtcgaggtcgacgaaatgcacgccgaagcccatcgggcggcccctcagctcttccggcaccagacggcggtcgttcggaatgccggcgagaaagcgcgacaggtacgcggccggaatccggatcctgaagaccttgtcggtcgcgtcgtagtccgagaggctgagcacgaggtcggtcccgctgatctcgtaggtcttcaggttgaggcggtccagcaggatgaagatgccgccgttgacgggccaggtcttgccgccatcggctgccgtgttccagtatccggtgtcgttgtagccaccgccgttcagcgtcggaatcacgacggggaggtccggctgccggtagcgggtgccgaatttcccgtagtcgcgcacggtattgaaattccacttctgcttcgtatggaaggcgacggccagccccagtacggaatcgacgccttgcggagactggaccagcgtcagttgcgcgtcgacgatgccctggtcggccgataaacccgaatcgctgatggtcaataccggggaatcgtagcgggtgtaatccgggaaacgctcggacagccacgtataaacaggcggcgcggccttttcctgcgcccgtgccgcctgcgcggcgaacaacgacattgccagcaggccggcaattacaaaaccacgtttcatttcggaatgccctctctttggttttctgttttctgaatggaggtggcgcgggccgccacggaattccatatctgttttccggcaagggtatcagttttaagcctgcgggttgaagtatgccgtttccaactcgcttgcccgcgatcgggccgctggttattctgacgcgcatgacccattcgccaatccgttcgattattcgcgccgcgatattgccggcggggtagcgatcgactgaatggatatcgtcacaacccgcctggaaggcgggtttttgctttccgggcattcgacggagaacctggaaatgcagacgaagtcacttcacgcgacggcatcggacgatgccgtgttgctccacatggtatgcggcaagatcgcttccggaaaatcgacgctcgtcgcgcggctcgcgagcgccgggccggtcgttgcgatcagcgaagacgcgtggctcgcgcatctttatccgggcgagatcctgtcgatcgacgactacgtccggtgtgcacggcgcgtcggcaacgtgatcgcggatcaggcccgcgcggtgctgcaggccggcgtgtcggtggtgctggatgtgccgttcaataccgtcgccgcgcgcgcatgggggctcgccgtttcgcaggccgccggctgcggccatcggctgcattacctctacgtcaccgatgcggtctgcaaggcgcggctgcgcgcgcgcaacgcgcgaggcgaccatccgttccaggcgtcggacgccgagttcgacaggatgacgcggtacttcgtcgcgccggcggcgacggaagggttgaacatcgtcgcttatgacgaagccggcgtcgtcaggccgggttcgtaagggaggcacgtcgatcgtccaccgggacggcgcgaaaccgctcatcggcgattgaaccaagggcgttccggccggcggcggcgtgccctttgcagcgcgccggagccggaggagaatacccgcggaaatctcttcggaggctgcccgacatggcccgatttcagcccgacggatggcataccgtcacgccccgcatcgtggtgccggatccggaacacctgatcgaattcatgcgatcggtgtttcacgcccagggcgcgtttcgacccgggttgcccgcggaaatccggatcggcgattccgtcgtgatgatcagcggcgaggacggcctgcgcgatccgatgcccgcgtttctgtatgtctatgtcgaggatgccgacctgacctatcggcgggcgctcgcggcacacgcgattccgctcgaagcgccggccgacatgccgtatggcgacaggcgggctatggtgaaagaccgctggggaaatacatggcagatcgccacgcatctgcgcgatctctcggttgacgagattcgttcacggctggccggcggtggttagatacctgtcgggacgcgtcgagcgattcgcgtgcctcgtgttccgcccgacgctcgcggaaagtgactgacgcaatcgtttgtactgcttggcgcacgagtcgagcgcactttctgcttcctttgtcgcaatcgtcaagattcgcgtcgcgtgcggataaaacctcccgctccacccgccgttaacccgttcgcagcccatgcgccgcgtgttgcgacacggcgcgcgtctttcgtgatccggaatccacatccgccgctggccgcgcccggccggcgcaagggaacgtcatgcgaaaacaactcactatccgtggtggtctcgtcgcgaccatcgcgggttataccgtgctgctcgtgctggtggtcggcgcatgcatcgcggccctctatatgggcaacggttcgctcgaggcgatgtaccgcgacgacaccgcgtcgctgctgcacctgaagaccagctccgagcgcatgctcgtgctgcgcgaacggatgagcgacgtcgcgcaggtcatcagcgccggccggtcggcgaaggcggaggtcgcgaaagtccacgcgctcctcaagcagagcaacgacgaactggatgcctacgcgcgcctgcacgcgcgcaacgccgacgaacaggcgctgttcgacacgctgcagaatcgccgtcgtgccctgctcgacggcgtgttcctgaaggcgctcgcgcaactcgacggcgacgacgcgttcggcttcctcgacacgcaacgcaccgcgccgcccgccctgttcaccgcgtaccaggaggcgattgatgcgctcgaatcgttccaggtcgcgcgtgaaaaggcgcgctacgaggcggccggtgtcctttccaccggatcgtgtggggatggtcgcggtcgcggtgctcgcgctcgtcgtcggcttcgtggcgcagcgcgtgctcgcgaaggcgatcatcgagccgatcaggctcgcggtcggccagttcgaaaagatctcgaagggcgacctgaccggcacggtcgtcgtgcccggcgagaacgagatggcgtatctgctgcatgcgctgaagcggatgcaggacggcctcgtcgacaccgtgaaccaggtgcgcacgagtacggagacgatcgtcggcgacgtccgcacgatcgcgagcggcaacgtcgacttgtcggcgcggaccgagcagcaggccgtttcgctgcagcaggcggcggcgagcgtcgagcaactgacggcggccgtgcgccagaacgcggacaacgcgcgcgatgcccgcacctacgtcgagggcgcggcgggcatcgcgtcgcgcggcggcgacgcgatgcagcgcgtcgtcgagacgatgtcggcgatttcgcacagttccgcgaagatctccgggatcgtcggcgtgatcgagagcatcgcgttccagaccaacatcctcgcattgaacgctgccgtcgaagccgcgcgcggcgagcaagggcgcggcttcgcggtcgtcgcgaccgaagtgcgcgggctcgcgcagcgctgcgcgtcggcggcgaaggaaatccgcgagctgatcggccattccgcgcagcgcgtcgaggacggcagcggtctcgtcgccctggccggctcggcgatggccgaactcgtcgccgcggtcgagcgcgtcaacacgatcatgagcgacaccagccacgcgttcgaagagcaatcgtcgggcatcgagcaggtgaacgccgcggtcatccagatggagcaggcgatgcagcgcaatgccgcgctggtcgaggaggccgcggccgccgcgctgtcgctcgacgaacaaggcgcgcggctgagcgcggcggtcgcgcagttccgtctgcgtgacgacgcgctcgcgtgatgcatcgaggcgggcaccggatcgccgtgccgcgctcgcggcacgacacggtgtggacgtcgtcgaagcagcacacttctggtgcggacatcctgactgccgatattgacgcaaccgatgcgtcggcacgatgaggaaccggatccgggcgagcgtcgaaaccgaggcgacgccgttcgcgttcagtgcccgcgatgcggcgacggcggtgcggcgacgcctgtcggcaagggcggcagcgcgattgccgccaggttctccacagggttatgcacggaaattgtggataagtcggaggacggtgcataactgccgacgcgttcctgaacgcggaggttgcaatgtgacatcgcacggcgcgaattgctttgctggaaagatcgtttagtggccgaggcggatcggaatagcatgacgactccctcaaccggccgtcgcatgcgaggccgatgattgcgaccgtaccggcccgaccatgacgacactgaacgactatctcgaacagaagcgcgacgcctggctcgcgaaaaaggatgccgcgcgcaacgatccggaattcaaggcgacgccgctgaaagcgaccgtgcgtgcactcggccgcagcggcgtgcgcgagatccgcattcgcgatttccaggtgatcagcgacagtccgcccgattttgccggctacaacctcgggccggcgtcgcctgagttgcagctcggcgtgctgggcagttgcctgacgcacatcacgctgatccaggccgcggagcgcggcctgaagatcgactcgatcgaagtcgaggtgaccggcgaccagcatccgctcgcgcagcagccgggcttcgagcatgtgccggtgttcccgcacaacctccgctacacgctcgatatcgtgtcgcccgaaccgccggagacgattcgtgcactgcatcaggcggtcgaggccgtgtgcccgatcttcaacctgttgacgctgccgcagacgatcgacggcgaattgcggcatacgcacggttgagcacggttgatgtgcgtcggtgcaccggcgcgtcgcggccttgcatgaggctgcgacgtgagcgggcgcgctcgatctctcgcgcaccctgttggggcgccgatacgacggcgatgctcgccgcacgcgcgtgacactgcggatgtgtcgccctggcgttgaacgtgtgccggatcgggggcgggagatgccggcgacgaatcggtgatgaatcagtccggaatcagatcgcgcgaattccggattcctcacgcgggttgtcgtgcgtcaaacgcttcgccccgtcggcacgatcctgaagatgctggaacgcgtccagcagccgcgcgcgcagcacggccagcgacgggtcgcggcggtcgcgcggtcgtgcggcctcgacatggatctcgtcgtcgatgcggcccgggtcgggcgcgagcatcagcacgcgatcacccaggtacagcgcttcgtcgagatcgtgcgtgacgacgatcgcggccatccggtgccgcgcgacgacatcgagcagcagcgtctgcaaccgcatccgggtcatcgcgtcgaccgcgctgaacggttcgtcgagcagcagcagatccggttcgccgaacagcccgcgcgcgatcgcggcgcgctgggccattccgcccgacaacgtggccggcagttgccgggcgacgccggcaaggccgacttcgtcgagcagccgggcgacggccggcgcgcgcccgcctcgcgggccggccgcaaagccgacgttgtccgcgatcgataaccacggcagcagtcgcggctcctggaagatcacgccgacgcgcgggaggggccgtcgagcgcgacgcctcccagcttcacgctgccgcggaaatccgtgtcgagaccggcgacgatccgcagcagcgtgctcttgccgcatccgctcgggccgaccacgcagacgatctcgccgcgcgtgacctgcagcgggacgtcggcgaggatcgtgcggtcgccgtaatacttgcgggtgatgcgcaggtcgagcagcggtgttgccgcgtccgctgccgtgtgtgcggaagcgcgcgtgctcatgtcgacaccttgcgtttcgcgtgatcgaatgcgtcgcgccagccgagccagtgcgactcgatgcgcgccatcgcgccgtcggtcagcttgccgagcaacgccagcagcaggatcgcgccgaacacgagatcgggccgcccggtctcgcggccgtcgctcagcaggaagccgaggccgcgcgtggccgcgatcagctccgcggcgaccatgaacatccacgcgaggctgaggccggtacgcaggccggtgacgatctgcggcagcgcggccggcagcaggattcgccggaacagcgcgagcgggccgagccggtacacggcgccaagctcgacgagcttgcggtcgacgtcgcgaatgccggcgaccaccgcgaggtggacggggaagaatgcgccgatggcgatcagcgtgattttcggtgcttcatcgatgccgagccacagcaacagcaccggcacccacgcgagcgacggaatcgcgcgcagcgcctggaacgtcggttcgagcagcgcgtcgatccgtcggctcaggcccatcgccgcgccgacggcgagcgcgagtacggcgccggccgcgaaacccgccgcgacccgcagcgtactcgcgccgacgtggcgcgccacgcgcgtgacgcccatgccggcgagcgtggcgagaatctcgctcggcgccggaacgagatgggccggcagccagccctggcgcacgacgacctccagcaacgcgagcaccgcgaacggcagcgtgaggcccgcgagccgccaccggcgaagcggatcgcgccggccggcgcgcggcgacgcggggcggcgaggcgcgagcgtgtcgtcgcgggcagcgctgttcgtcatgggcggcaggctcagtgcgaagcggcgacgagcgggcgcacgaacgccgggtcgatcagcgtatcgacgatcttcgcgggatcgacgccgggtttggtcaactgctcggccgtcagcaccggcgcggctgccttcagtgccgcgcgctgcgtttcgccgggtacggggtcgctgaagtcgttgcgctgaagctgcagtttcgccaccggcagcgacaccttcgattcgtcggcgacgatctgcgcggtgtcggccggatgcgcgacgatccactgccgcgcgcgatcgtagaccttcagtacgcgcgtgaccgcttgcgggtactggctggcgaacgcgtcgcggacgttcaggaaaccgtaggtattgaacgcgacgttgcggtagaggaggcgggcgccgtcgtcgagctgcgccgcggccatgtgcggatcgaggccggcccacgcatcgacctggccgttcgcgagcgcggtgcgcccgtcgggatgctgcaggttgacgatctcgacgtcgtcgcgggtcaggccgaccgtgtgcagtgcgcgcagcgtgaacaggaacggatcggtgccgcgcgtcgcggcgattttcttgcccttcaggtccgcgagcgagcggatcggcgaatccttgcggaccacgagcgcggtccactcggggcgcgagaacacgtagacggtatggatcgggttgccgttcgcgcgtgcgagcaccgacgcgagacccgcggcggaaccgaagtcgaccgcaccgctgttcaggtattcgagtgcgcgattgctgcccaggctcagcacccagcgaatcgacgtgcggtcggccttgaattcgtcctcgagccagccgaagtggcggatcaccaggctctccggcgagtagtacgcgtagtcgacgcggatttccgcgggcgtcgctgcgcgtgcgtgcaccgagacgaggccggcgaacgcggcaacgacgagggccgcggattgccatgcgcgggaccaggacagcttcatcggggattctccggaagaacggcaacgagccggggacaggcagggtgaccggctaatgtagcgaagccgcggggtttcggtaacgaagaaatccgcgattgaacatgcgcgttgctgataagcgcgggcggcgggcaactttatgacgcgggtcgattaatttatcggtttatatcgcttgggagaagcggatcggaagaacagaatgcctgctgccggagctcgacggcgtcgcgtgtcgagaggcgtgcagttgcgaagggtcgttaccggccgcgattgaacacgcacgacttccggtttcatgcagacatcgccggcctgtcggcggaaaacaaaggagtgcgatgagttcgatcgacctgaatgccgtcaccccggcttcctccccattcgctcggcaagcgacgtcgcgcgcctgatcaacacggtggacagctccgtcagccatgcccggatgatcgtgctgctggcactcggcggcgtctttctcgatgcatacgacctgacgacgctgtcctacgggatcgacgacgtggcgcgcgaattcggcctgacacccgcgctgaccgggctggtcgggtcggcgatcatgatcgggacgatcttcggcagcctgatcggcggatggctgaccgacaggatcggccgttatcaggtgttcatggccgacatgctgtttttcgtggtcgcggcgatcgcggccggtcttgcgcccaatgtatgggtgctgatcgccgcgcgcttcgtgatggggctcggtgtcggcatcgacctgcccgtcgcgatggcgtttctcgcggaattctcgaagttcaacggtcgcggcaacaaggcgtcgcggctcgccgcgtggtgcccgatgtggtacgtggcgtcgtcggcgtgcttcctgctgatcttcgggctgtatttcctgctgccggccgagcacgcgggatggctctggcgcgcatcgctgatcttcggcgcggtgccggccctcgtcatcatcctgttcaggaaccgcttcatgaacgaatcgccgctgtgggccgcgaaccagggcgacctggccaatgccgcgaggatcctgcgcgagtcgtacgggattcacgcacacgaggcggaggacgcgcgacgcgcgccgagccagccgcccgtgcgcattcgcgtgctgttccagcgcccgtacctggggcgcacgatcgtcgccagcgtgatgaacctgtgcattccgttcgaatacacggcgatcgcattcttcctgccgtcgatcctgtcgcagtttctcggtgcgggcgtgttcgaaacgattgcggcgtcgctggcgctgaacgtgctgtttgcgttcaccggcggtttgctgggcatgcgcctggcccatcgccatgcgtcgcgccatgtcgcgatcgccggtttcgcgctccagttcgtcgcgctcgtggcgctcgcgctggccgggcatccgcatggcgcactcgcgatcggcttcgtgctgctgatgctcggcacctggctgttcgccgaaggtttcgggcccggcgcgcagatgatgatctacccgacgctgtcgtatccggcgtcgatccgcggcaccggtgtcggcttcgggcggtcgctgtgcggcatcggccaggcgctggcgctgttcgtgctgccgatcctgcaggcgcgtctcggcacggacatgttctgggtcgtcgcgatcagcgccgcgacgccgatcgtgttcctgctgatcgtgcgttacgagccgacggcgcgtgacatcgacgacgacggcgcagagtgaaggcgatcgggatcgttcgtcggctggataacgcgcgcactttcttcagtgcgcgcgtcgtcgttaccgcgatatctacattgctgtcgatgcgcgagtgcgcagccggaacgcgcggcggagccgcaccgggcttcttcgagtgaggggagagcagcgatcgggcgaggtgtcgggcgagcggcccgacgcaccggttgctgcccgtcgcgaagccggccagcccgcacacgggccgaccagccgccgcgatgccgtccgctcaggccgctacccgctcggcatcgcgcttgacctgctcgatgtcgcggaactgcgcggccggatgttcgtccggcagccgcgccgacccgccgaacagtttctcgcgcagcgtgcccggcgcatagccggtcggatacacgccgcgccgctgcagttcgggtacgagatgacgcacgacgtcctcgaaggtttcgtgcgcgaccgcatacgcgaggttgaagccgtccacgtccgtcgcggcgacccattcctgcaggatgtccgcgacggtcgccgccgagccgacgaacaccgggcccaggccgccgatgccgccccaggccgccagttcctcgatcgtccaggcggtgtcgccgcccgacagatgctcgaccgccgatacgatcgcattcgtctcgacgcgccggacgggatcgttcggcgcgtactggccgaagtcgatgccggtccagccggacatgaacaccagcgagccgtcgtacgacacgtacttgcgatattcgtcgaacttggcctgcgctttctcgtcggtttcgtcgacgatcacggtgacgaggttgtagatcaataccttgctcgcatcgcgccccgcggcggtggcctgcgcgcgcacgtcggccacgtagcgcgcgagctgcgcgcgggtcggcgcggcgacgaacacgcattcggcgtgctgcgcggcgaacgccttgccggggccggacgcgccggcctggaacagcaccggcgtgcgttgcggcgacggttcgcacaggtggtagccgggcacgtcgaagaaccggcccttgtggccgatctcgtgcaccttctccggatgcgtgaacacgcggccgtcgcggtcgcgcactaccgcgccgtcttcccagctcccttcgaacagcttgtacagcacctcgacgtattcggccgcgaccgcataacggtcgtcgtgcgtgcgcaggccgtggtcaccgatgttcttcgcgccgctttcgaggtaggacgtgacgatgttccacgcgagccggcccttcgtgtgatgatcggcggtcgacagccggcgcgcgaacgtgtacgggtgttcgaacgtcgtcgacgcggtgatgccgatgccgagatgctcggtcgccatcgcgatcggcgcggcgagctgcagcggatcgttgaccgggatctgcgcggcctggtgcagcgcgtgatagttgctgcccttgtagacgtcgtagtagccgatcacgtccgcgatgaagatcgcgtcgaagatcccgcgctcgagcacgcgggcgaggtcggtccagtagtcgagatccttgtactgccacgaccggtcgcgcggatgggcccacagcccgggcgactggtggccgacgcagttcatctcgaacgcgttgaagcggatggtcttgccggtcttgctcattgggcggctccggtttctgcttgcgtgcccgcgccgttgccgacctgccagacgaacggcggcgtgcgcccgttgatgacccagtcgccgacgatccgcgccttgtagacgagcggattgtgcgatgacacggtgcgcgcgttgcgccagtggcggtcgagcgccgtcgtgctgcgggtggcggacgccccgagcgcgtcgaacaggtgcgtcgccgcacgcaatacgagttccgacacgacgagctggctctgcgcggattcgatctcggccgcgacgttcgcgtcgtgctcggccgccgtgtcgccgccgaagtgcgcttcgtaggcccgttgcagcggctgcgcggcgcgctgcgcgagcgcgtcggccgcgtaggcccacgacgcgatctcgccgaccacctgctgcagctgcgcgtcgtcgcccgcacgcgatgcgttgccgtggctgtacacgcgggtgcggtggcgcaccagctcgccggcgtcgcgcacgatcgcgtggccgatgccggccagcgtcgcgacgtggaagagctggtagaacgcggtctggtacttgaagcgtcgcgcgaagtcgatcacgtcccgtgcgtcgaccgtcgcgtcctcgaagcgcgtggtgccgctgccggtcgtcgtctggccgaagccgtcccagtcgtcttcgcggatcacgccgggctgcgcggtcgcgacggcgacgatcacgtcgctgccgtcgctcgcgcgttgcgcgaacacgtcgatccagtcggcaaacaggctgccggtgctgtagaacttccggccgttcagcacgagccggccgttcttttccgacaccttcgtgatggtctggccgagcgacacgtcgccggtctcggtccacgcattgccgacgagctggccgctcgcgaagcggtcgaaccatgtctggcggtcggcgccgggcggcgcgttcagccagtcctcgacgaacgcgaagtgcccgcgcaaggcctgcggcagattggaatcggcggcggccagctcggtcagcagccggaacagctgcggaagcgatgcgccggcgccgccgtcgcgcacgggcagccggacggcgccgaagccggcggccttcagccagccgatcgcctcgtgcggcagttcgcggcggcgttcgcgttccgcggtgccggccgcgatgcgttcgaagatcggcctgaagcggctggcaagcgcgtcatagtcggtgccggtggaaagttcggttgcggcgggagatgaagtcatgcggtgatccttgaaaggcgggggccgtcgatgccggcaggccagtataggaagcacgatgcggacgatccaataacggattcgtacatccttatcgctgccgggcattacgcgggcgacgcgccgtggcatcgatgccggggtgtcgatatcgctgctgacgcgcggtttttgcgcgcggcgtgccgcatcgtttgccgttcgaaggaatatcgttgtgcgaatcgctcggtttgccggcgctcggtgcgctgctagattgaacgtttccgtcaaccagcaggagagcccgatgtcagagacgagcgccacgatccaggaacgaccggccgatacgcaaccgcaggcggccagcctgatcgccgacgacgcacaggccatcgcggccgcgcacgcgcttgcgcaacggctcgcgcaaggtgcggccgagcgcgaccgcgagcgccggttaccgcgcgacgagatcgaatggttctcgcagtcgggactgtgggccatcacggtgccgaaggcttatggcggtgcgggcgtctcgcatgtgacgctgacggaggtggtgaagatcgtcgcggcggccgatccgtcgctcgggcagttgccgcagaatcatttcgggctggtcgacgtgatcgcgctgaccggcaccgacgcgcagaagcgcctcttcttctcggaagtgctgagcggcaagcggttcggcaacggtttttcggagaagggcacgaagcacgtgctcgacctgaagacgcgcgtgcgccgggacggcgacgattacgtcgtcgacggcaccaagttctattcgaccggggcgctgttcgcgcattacgtgccggtgctcggcctcgacgacgagcgccgcgcgtggctcgcctacatccgccagccggcgccggggctgaccgtgatcgacgactggtcggggttcgggcagcggaccaccgcgagcggcacggtcgtgctcgacaacgtgcgcgtgcctgcgtcgcacgtgctgcctgcgcagcgcgtgtcggacctgccgacgctgaacggcccgctgtcgcagattatccaggccgcgatcgacgcgggcatcgccagggccgcgctcgacgatacgctggcgttcgtgcgcacacgcacgcggccgtgggtcgacagcggcgtcgagcgcgcggcggacgatccgttgacgatccgcgagatcggccatctgcacattcaactgcatgcggcggaggcgttgctcgagcgcgcggcgcgcacgctcgacgagatcgcggcgcgcggcgatgtgaccgaggacgacgtcgcgcgcgcgtcggtggcggtgggcgaggcgaaggtgctgacgacggagatcgcgctgctcgcgggcgagaagctgttcgagctggccggcacgcaggcgacgctttccgagcacaacctcgaccggcactggcgcaatgcacgcacgcatacgctgcacgatccggtgcgctggaaatatcacctcgtcggcaactactacctgaacggcgtgcgcccggcgcgccatgcgtggaattgaatctattgcgatcgtggctgcttcgcccggcgatgactgagcgagccgccgcggtctgatgcatccacacgatcgtgtggcgaacccggcactgcgttcgacgcgcaggcgccgggatcaacggcggatcgggctgccgatcgtgtgccgtgcggcacttgcggcgataatcggcatcccgacctcgactgccgcccctcatgtccctccctgcattcgcaccctttcaggatctggccaaggccctgctggctcactggagcggcgccgacggcgacggttcccacgacacttcgcatctgcaacgcgtgtggaagaacgcagccgcgatccacgcgaaggagggcggcgatgccgaggtgctgttcgccgcgacattgctgcacgactgcgtggcggtggagaaagattcccgcttcgcgcgcaggcatcgcggctgtcggcgcaaaaggcccggcaggtgctgaagtcgctggattggccggacgcgaagatcgacgccgttgctcacgcggtcgaggcgcacagcttctcggcctgtgtcgcgccgacgacgctcgaagcaaaggtgttgcaggacgccgaccggctcgatgcgatcggcatggtgggcgtcgcacggtgcttttatgtcgcgggccggatgggtagcgcgctgtacgacccggccgatccgcacgcatcggaacgggaactcgacgacacgcgtttcgcgatcgatcacttccgcacgaaactgctgaggctttcaaccggtttccagaccgccaccggtacccggatggcgatcgttcgtcgcgaccggttgcagcgctttctcgacgagtttgcagacgagatatgatccggccgcgcgtgacgaagcggcccggtactatcggcgcatggagcgcgaactggcggatcgcgagtttctggccggcgcgtattcgtacgccgacatcgcgttctacatggcgcagttgttcggtgcgcgcaacggcgcaccgatgacggatgaaacgccgcgcctgctcgcctggcgtgagcggatgaccgcacgtcccgccgtgcgcaaggtcgccggcgcgatggccgcgtatctcgcctcgatcggagaagcggttcccgattttcttcgcgggctcgattcgctgctgtcgggagcggacaggcgcgggaagacggccttcggcgacgattgccgctgaaggccgcgtcggcgctttccgtgttcagccgcggatgaacgcgagcaggtcggcgttggacgtgggcgcgccgtgcgggaagccctggtacgtcttcagcgtgccgttcctcgccagcttcgccgacaggagaccggaatcggcatacgggacgatcgggtcgtcgtcatgcatcacgagaacgggaatcgtggtgcttttcaggtcttcggtgaagtcggtctgcgagaacgcgacgatgccgtcgtagtgggccttcgcgctgctcatcatgccctgccgccacccgttccggatgacgccttgcgacggtccggcgccgtcgcggttgtagccgtagaacggggcggccgtcccgacgcgacccgacgcacccctctattccggtccttgaccttgaagttgacttcaagcctagagtgcttgttgacggcggtgagtcagcaggcttcgggtgttgcctgccacggtcgatcatcgacgagaggcgacgaacatggacaggcggtttacacaggtcgaattcgggccgcacacggtcgacgtgcccgaaggcgggtactacgaccggttccggatgaatcccgacctcgatgaggtggcgcgggatcccgccgcggggaacatcgatttttccgtcggattccgaagcgtcaggtcgcttcgcgggtcggcccgacctgggcgccgaatttctactaccgttccagcagcattcagctgctgttccttgcgccgctcgaacgcctgcggaccacgctgccggtgccgctcgaaccgctgcgtgcgctgcccgggtacgggctggtcgcgctgaccttcttctcgtattcggtgtgcgacaacgatccgtatgacgaagtgtccgtcgcggtggtcatccgccggcccggcgcgacagggtcgcacgcgcgcgagctgatcgattcgatgcggcgccggagcttcttcgcgtacgtgctggcgctgccggtcaccacggaaatcgcgcgagtgcgcggcgtgcacggttatcagttgcccaagtggctcgccgacatcgacgtggacctcggcgccactgcccgcgcacgcatcgccggcccgggcgaccggccggacctgagcctgagcgtgccgctgccggcactgacccacgttgcatcgcagtcgcacatgggctcgacgacgatgatcaatcgcatcgacggcgaatggcaccagacatcggtgcagacgaatgcgctatcgttcgcccagcgcctgttgccgcgcaacgtcgagctcgtacggcacggcggcccgttgagccaactgctcgacgggctgggcgcgtccaccatcctgcgtctcgacgtggtgaaggacgcgcaactggtcctgaacctgccgaccccgttgaaggccttcgatgcccggaaagcaacgctgacgccatgtccgttcgcggtacccccgcgccgaaggaatccccatgaggaaccgcccatgacccggccgacctacgatctcgttgtatttggcgccaccagtttcgtcgggcagatcctggcccgttacctgtccgagtacctgtcgggctccggcgagacgctgcgctgggccatcgccggccgctccgaagcgaagctcgggcaggtcagggatacgctgggtgcggccgggcagtcggtgccgatcatcgttgccgatgcggccgacgaagcgcagcttcgagcgctctgcgcgcagacgcgcgtggtcgtgtccaccgtcggcccctatgcgctttacggggagccgctggtcacggtctgcgcggaaaccggtaccgactactgcgacctcaccggcgagacgcagtggatcaaacggatgatcgacaggtacgaaccggcggcgcggcaatccggcgcgcgcatcgtccattgctgcggcttcgattcggtgccgtcggacatgggcgtgttcttcctgcagcagcaggcgcggcagcggtggggcgtgccggccgcgcaggtgaagatgcgcgtcaggacgctgaagggcggcgcgtcgggcggcacggtggcgagcgtgatcaacgtcgtccgcgaagcggccgccgatcccgcgttgcgcagggaactgctcgatccttattcgctgtgcccgaaggggcacggcttcacggtacgccagcatgcggtgcgatctgcggcgttcgatcgcgacttcgacgcatggatcgcgccattcgtgatggcggcgatcaacgagcgtgtcgtgcatcgttccaatgcgctggccggcaacgcgtacggcagccgcttcacgtacgacgaagcggtgatgacgggcacgggcctcaagggccgcctgacggcgctgacgatggtggccggcctcggcgcgttcatggtcggtgtcctcatcaatccggtgcgcagcctgatggaacgttttctgctgccgaagcccggcgagggccgagcgcggccgcccagctggccggccgttacgatttgcgtttcttcggtcgtgccgacgacgggcggaccttgcgcgtgaaagtcaccggcgaccgcgatccgggctatggctccaccggcaagatgctcggccaggccgcgatcggtctcgcgctggattacggcggagacggtgtcaagaccggccgcggcggcggcttctggacgcccgcgacgatgttcgacgagcgctacatcgagcgcctggttcgccacgcggggctgcgtttcgacgtgatgtgagtgcgcgcgccgtcggccctgcgacaggaagccgataaagatcggatagcgaatcaatttcaggagacaacctgcagtcacgacgggacggatggccggatgcgatccggcgaaggagtatcggaacatgaagatcggggaactggcggaacgcaccggccttactccttcgcgcatccgcttctacgagcgcatcggtctgttgacactcgtcgcgcgcgaagcgaacggctatcgctcctatccgcaggaagcggtgacggtgctcgatctgatcacggccgcgcagaaggcggatttcagcctcgacgagattcgcacgctgattccggccggcctcgcgcagtggccatgcgattcgttgctggaggcgctgcaccgcaaggtgcgggacatcgaggcactggaggcgcggctggcgcgcagcaaggcgcaggtcatgtcgctgatcgccaaaatcgcggcgaaaccggcgtcggtcgattgtgcgacccatgcgaaacgattgctgtcgcgggtcccgccggggaatgcggcggatggcggcgaggctgccgccggattgtcggatggcagtacacatacccatgacctcgatacgctgccgaggcgaaccataaccattaagcaaagttgaaggtcaagaccctctcgttttcgcttttgttttcgtcttcgctgcccgcacagggctggcgggcagtatgagtccgtccagcaaggttgtcagcgcatcttcgatcgcgtgatcgccgaccttctcgcgcaccagccgccggtcgatcgccagcatcgtcaggccgtgcagatgcgcccagcaggcggtcgcctggccgagcgccgggcgcgggcggatcgtgccggcgcgctggccgtgttccaggatgtcgacgaccagcaggaaaggcgcctgcacgcgcggatcgagatggatgtccgagggctcccctgcatccgcggcaaacatcagtcgatagagatccgggttgcgctgcccgaacgcgagatgggcatacgcgagcgccagcagcacgtccggtgcgctcgccgagggatcgatggacgcggcgagatcgtcgcgcaggcggtcgaagccgatcagcgcgagctcgtgcagcaacgcggccttgtccgggaaatgccggtacggcgcggagtggctgacgttcgcgcgccgcgcaatttcgcgcagtgtgaattgccagccctgctgctcctgcagcgtgtcgagcgccgtttcgatgatcgcgcgacgcagatccccgtggtgataagccttttgcccggcgtccgcatcctcatccgacgacatcgtgttgctcctatgttgacaggggacacattgtggccctatgatccgccgcatgcaagttgacagtgtctacatcgacgcaacctcgtgaggcgcaccatggccgtttccgcagaatccatctcgagcatcgacccggcggtgctgctggcccgccagcgcaacgcgttcgtcagcgagggccgccgaccttgccgcagcgcaaggcccggctcgcgcggctgcgcgccgtggtgctggcgtatcgccgcgaagtggaggaggcgatcagcgccgatttcgggaatcgctcgcggcacgagaccgcgatcatggaactggtcggcgtgatccaggcgatcgactacctgacgcgcaacctgcgccgcttcacgaagccgcagcgccggcacgtcgggattttctatcgggccgggcaggctcacgtggagtaccagccgttgggtgtgatcggcgtgatggcgccgtggaattacccgttctcgctcaccttcattccgctggcgaccgcgctggccgcgggcaatcgcgcgatgctcaagccgtcggaactgacgccgcgcaccagcgaggtgatgcgccggatgctcgcggagaccttcccgagcgaagaagtcgcggtcgtgctcggcggcccggaagtcggtgcggccttcagcggcctgccgttcgaccatctgctgtttaccggcagcacgcaggtgggccgcaaggtcatgaaggcggccagcgagaacctggtgccggtgacgctcgaactcggcggcaagagcccggcgatcgtcgcgcgggggcatgtcgacggccggacgatgtcgagcatcgtgttcggcaagctgtcgaacggcggacagacctgcgtggcgcccgactatgcgctggtgcatgaagacgacctggacgcgttcgtcacgcaatacgatgcggccgtcgcgcgcttctatccggacgggccgacgagcctggattacacgtcgatcgtcagcgaccggcattacgaccgcctgaaggggctcgtcgacgaagcgcgcagcaagggcgcgcgcgtgatcgaggcgggcgtgagcccgcagcaggcggcgacccgcaagcggacgctcgcccccacgctgatcgtcggcgccggcgacgatacggccgtcatgcaagaagaaatcttcgggccgatcctggcggtgcgcacgtatcgcacgatcgacgaagtcgtcgactacgtgaatgcgcgtccgcgtccgctcgtgctgtattacttcggtgcgcaggacggcgactgcgagtcgctgctcaagcgcaccacgtcgggcaatgtcggcatcaacaacacgctcctgcatgtcgcgcaggaagacctgccgttcggcggcgtcggtccgagcgggatgggcgcgtatcacggcatcgagggattccgcgcgatgagccacgcgaagggcgtgttcgtgcaggggcgctggaacctgccgagcctgctgcgcgcgccgttcggcaagctcgcggatctctcgctggcggcgctgctcgggcggagccgggaaccggtgggcgtgcgcgcgggattgagcgccaagcgctgaacgcggccgcacgatgcctgctagcgcatcgtgcgcttgcccgctcccgtgcgaacggcggcttcgtcgaagatcgtcgcggcgaattcgaccgcggcaggcatccgcgcgtcatgcatcagcacgaattcgacttccggcagttccggcaagccgtcggccacgccgagttcccggagcgtgccgtcgatcgcgctgcgcggtaccggcgcgatggcgatgccggcgcgcacgcatgtccggatgccggcgacgctcgggctttcgcatgcgatccggtagcgcaggtcggccagcgcgagtgccttgagggcggcgccccggtacgggcaaggatcgggaagcacgcgagcggcacctcgccttccggcaaccgctcgtggcgcgcaaatgcccagacgagcggctcttgccacaacgtcgcgccctgatccgtgtgcgcgcaccggctgccgatcacgagatcgaattcgccgtcggcatgccgccgaaacaggctgtcgccgatgtcgaccgtcagatccagccgcaagccgcgccgcgtggcggagtggcgacgcatcgcgtccggcagccagccttccgcgaaatcctccgatgcgccgatgcgcagccgggtatcggctgcgtcgccggctcccagccgcgccctcgcttccccgctcagattgagcatcgcgcgcgcgtagccgagcagcgtcaggccatgcgcggtgagcgtgacgctgcgcgtattgcgcacgagcagcgcctggccgacctgttcttcgagacgaacgatctgggcgctgaccgcggactggctgagattcagcctgcgaccggcgccggtgaaactccgcacgtcggcgaccgcgacgaacgtctgaagcagcgccgtgtcgagaggattctccattgatcacaaatccgggttaattcaatcaattaatatcgtttccaaattataagcgggctcgatacgctgcgaaccgtagtgggcgaccgcgcatccggcgcgtcgccgtcactcctggcaaggaccggctccatgacgtgcgtgctctatatcgaaggctcacccaacaaggcatattccgcatccatcgaagtgtgcgatgcgtttctcgacgcgtaccggcacgcgcatcccgatcatgaaatacggaagctcgacgtgtgggatctggcgatgcccgaattcgacgaagacgcgctggccgcgaaatatgcggggctgagcggcaccgcgttgacaccgtcgcaggcagcggcatggcagcggatcgagcagctcgcagcgccgttccacgcagcggacaagttcctgttcggcgtgccgctgtggaatttcagcattccgtacaagctcaagcacctgatcgatgcgatctcgcagaaggacgtgctgttcacgttcgacgacacgggcttcaccggcaagctggccgggaaaaaggcggccgtggtctacgcgcgcgggctcggttttcagtcgccgggttcgtttacgccggccgccgagttcgatcttcagcgcccgtacatggaaacctggctcaggttcgtgggcgtgacggacgtcaccggcatcgtcgtcgagcgtacgttgttcggtgccgacggaaaggtcgatcgcagccgcgcgatcgacgaggcccgatcgatcgcgcgcgggttctgacgctgccgcgcagcgtatccggtgcgccggcgcgtcggcggtgtgctcccggcgcttgtgtcggcgtgcggcgcggatgcccggatcagcgcccgccgcgcgcgatggcgagcgcgacgccgaagccgacgagcaggcatccgaaggtgcggtcgatccagtgccgcagcgacagcaggtgatcgcggacggccgtcgcggagaagcacacggccaccagactgaaccagccggcgtgcgccagcgcgatgaatgcaccgtagccgatctgcacgatcaacggtgtgtcgggccgcacggcctgcatgaacaggctgacgatgaacaccgtggtcttggggttcagcacattggtcaggaagccggtgcgcagcgcggccaggtccgacagcggtgcggccggcgcgtcggcctgcccgctgccggccttcgtcatgagcatcttcacgccgaggtagaccaggtagatcgcgccgatcagcttgacggcattgaagagccacaacgattgccggatcagcaggccgacgcccagcagcgtgtagctcacgtgaaccgtcacacccagcccgatacccagcgcggtgagcacgcccgagcggcgcgacagcatcaggctgttgcgcgtgaccatcgcgaagtccgggcccgggctgatcacggccagcagcgtgatggtgaatacaactatcagttcggtcatcgtcctgtccttgcgattgatggcttgatggcgcaatcttatgggtcatgtttcagccggaaaagcgatgatttctgaccagaatggtgagctggattcacaatcgatgcgcgcgaacctgccttcgctgatggccctgcgttgcttcgaggcggcggcgcgtcacgagaatttcagccgcgccgccgacgaactgtgcctgacccacggcgcggtcagccgcgcggtgcggctgctcgaggacgacctgggcgtggcgctgttccagcggcgcagccggcgcgtgttcctgaccgacgcaggccgcaagctggcgcaggcggtccacgacgggctggggctgatgcgtcacgccgcgcaggaattgcgcaccgaggccgcccgggcgcggcgctgggtcctgtcgtgcgagccgacgcttctgatgcgctggctgattccgcgctggccggattttcaggcgcgacatgcgggcgtcgacgttcacctcgcggccgcgggtggcccgttttcattcgacagcggcatcgacatggcgattcgacgcaacgactttgcgtggccggcgggttaccacgcggagcgtctgttcgcggagcgggtggggccggtttgccggccggacaaggtcgatgcgtggttttccgctcgtcgcggcgagcgttcgttgaaggcggacgttccgcagttgcatacgcggacacggccggacgcatggaaggaatgggcggttgccgcgcatcagccggccgtgagcgggcgcgggcaggtgttcgaccatttctacttcagcctgcaggcggcggttgcggggctgggtgtcgccatcggcccgtggcatctcgttcgcgacgatatcgaaagcggcgtgctggtcgcgccgatggggttcgtcgaggatggttcgcattactgtctattgacgccggagccggtggcggcgggccgtgcacaggcggatgtgcttgcgtggttgagggcggtggcctgatcggcgcgctgacggccggctcggccagcgcgatcgggcgaccttggtcgccgttgctacggtcgggcgtccggcgcgaacgtcctgcccgtcacgtccacgatgaagtcgattgccgcgcgaatcgtcggcgcatgtctgaggtcggcatgcacgaccagccagagctcccgggcatacggttccccgtcgaacggcaggcgctgcaacccgggatcgccgtcgcccatgaacaccgatgatgggcgtgccgatggtcatgagcatcgcttccggcagactcaccggcaggctcggtgcgcgcacgctgacgacggccggcctgtcgatatccacggtcgggtatctcgcgatgtggccggcgatcgccgtgcactccaacgcgctgctcgcgataccgatgctgctggcaggcagcggcatcgcgctgacgataccgacgatcacggacgcggcgctcgcggcggtgaccgctgcgcagtcaggggtggcgtccgggttgttgaatacggcccggcaggtgggcggcgtgttgggcgtcgcgttgtttggtttcttcgttcgggcggcagacggcgcgacgttcgttcacgggatggcgcgggcgttgatcgtttcggttctgttgctggtggccggtgcggtgatggcgtggcggaatctggggcaggcagggagcgaggaattcgggctcgcggggcgagccctcaacgtcaatgaccgacccgatagacgcgaccgctatgcacgccttccacgctgcgtcgataggccatagccacacgtgacgccggcacgctctcgcagccgggaaagaacggaccgaaccgatccatggattccgtcagcaccgtcgggctcacgacgttgatccggatgccgcgcggaaaatcgcacgcggccgcgcgcacgaatccttcaatcccggcattcgacgcggcggcatgggcgccttgcgcaatcggatcatcgaccgcgatgcccgaggtcagcgtgatcgacccgccgtcgaccagatagtgctggcccaccagtgcgacgcgcacctggctcagcagcttgtcctgcaatcccttgtggaaatcggccgccgtcatcttctcgatcggggcaaggatgacattgcccgcggcggcgacgattgcgtcgacttgcccgatcttctcgaacagtgcgctcacgctctcgtcacgggtgatgtcgacctgatggtcaccggaggtgcgacccacgcgaacgacttcgtgtcttccgtcacgcgcaagctcatctgccacggcacgtccgacgtctccgccggcgccgattacaacgatcttcatggaaccactccttttcggtttcaggttggagcagccattgttcttcgaaccaatattgagataaatgtgctctaatttccgacactactaatcgccagttcgcaatatggacaagctgcgttcaatggaaaccttcgttgccgtcgtggaagggggcaacttcaccgaggcggcgcagcggcttggcatgtcggcggtcatggtcggcaagtacgtgcgcgaacttgaagagcgcctcggcgcgcgcatgctggagcgcaccacgcgacggcagagcctgacggatgcggggcgcgtgttctacgaagacgccaagcgcgcgcttgaacaggtgcggatcgccgagacgtcggtcgagcgattgcgcgcgtcgccgtccggcacgttgcggatcagcgcgccgattaccttcggcgcatgcgtcgtcgcgccgctggccgcgacgttccagcagatgcatccgctcgtgcgcatcgagctggcgttgagcaatcgcgtcgtcgacctggtggacgagggtttcgatctcgccgttcgaattggcgaactgggtgacgtcgacctgatcgcaaagccattgaccatgtatcgcatggtgatttgcgcatcgcccggttacctcgcgcggcatggacgtccggagacgccgcaggatctgggcatgcatcactgcctgtctcactcggtgtggaacggccgtaacgggtggaagctcggtgggtgggacgggccgcaggtttcgcaggatccggtcttcacgtgcgacgacgggaacgggctgcgcatggccgccatcgcgggcgcgggattgttgctgcagcctgaagttctggtggcgcacgatctggcgagtggcgcgctggtgccggtgttgcaagcgtacttgccggcgccgcacccggttcatgtcgtgtatcggcacgatcggcgaccattgccgaagctgactcgtttcgtcgagcatttgatcgagcatggtgcggggcgttgaagtcgaacgcaggtagcgatcggggattcgtggcgaatcgaatgtcgacaggaagcgacgcgttgcaagtgcgtggcacttgtgagccgaagcgatcgccgtccgctggcgccgcgccatttctgcgcggccgggattccattggcgaccacgtcgaggttgaacacccgggtttctaagcgagcgcgcggtggtacacgaagccggcattcgttccgccgccccgacctacggcgatctgaatattgaggtgtgccatcgcctcaagataacgggcgttgttcaaggggccggtcacgacgggcgcgaaccccgcgctttccgcgatctcggcgaccgtcgtgttggcctggacgtcgttgcccgcgatgaatgccgtaacggcatggccaccgcgatcgatgcgatccggcgtcatgatgtcggcgaacaccgtgttgaagcacttcaccagacgcgcgcccggcagcaggtggccgatcgcctcggctgccgatccgtcggcccccagcggaagtggcgaccagtcgtccttgagcgcattcgttgcgtcaacaacgatcttgccggccagccgatgcgcaagggagggaagtacctcggcgcacgcctgatagaggacggcgatgacgacaacatcaccatgcgtcgcggcctcttccagcgacgcgattcggtaccgggcgcccgggcgcgccctcgcgggattgcgcaagccgactaccacatcatgtcccgccgcgaccagcaattcggccagattcccgccaaagtttccaccgcccaggaatgcgatcttcatggcatgcacctcacgattgattgggtggcatcattctttcaattccggtttctgcaatcaattaggtacccgagggtaaccatgacgaagaagatcgagttgccgcccgatgcgttcctgaaagtctgtccgtcacgcgcggtgctcgcgcgtatcgggcagaagtggaccgtgctggccatggtcgcgatgaaggatgggccgatgcgttttggcgacatcaagcgccgcctggaaggtgtttcgcagaagatgctgacccagacgctgcgcgccatggagcgcgacggactggtggtgcgcaatgtctacgacgaactgccgctgcgtgtcgagtacgcgctgagttctctggccggtacgctgcttccgctcgtcatcgatctcaaggcgtgggcggagaatgcgctcgcgacgatcgaggcgagtaatcgtgcgttcgatcgtgagcatgcggagtagaggagggggttctgggtgagttcaagccatttatgtgctggcgtgctcgttgttcgcgcggtcactcgagacgggcgacgcacgcatgtcttccgacgcgtggggaggccgtcaccgcacccagagatttgcgaacggcacgaagcccaggggtgcggcctctacaccggcaacatgcgactccagctcgatatgctgatgctcgtgcgagatcgggatcagccagcccgcttcgaccagttgccggccgatctcctcgtagcccgtcatgcgcacgcgcgcatcggcttgcgcctgcagcccgtgcagcacgcgatccagctcaagcaccgcatcggccggcatccactgccgaaaaatgctgtcggcggcaaaccattcgtagcatccgaaatcctcgtcgtcatgcagtatctcgctgcccagcaccaggtcggccgcatccagccagtcgcgccggatcaactcggcataaggcagcgccatcacctgcagccggatatccgcctcgcgcagccgggcttcgatgatgcgcgccagcgcgagttcgtcatgggtttccccgtcaccagggtgagttctgtttgagcgggcaaggagggcacggggcccgatgccgcgacgcgatgctgccaggccggtaacaggccggccgcgggccgtcgcgcgggatcgtcggccctgaacaggcggccgggcgcaagccagtccgccagcgcgagccgctcttcgcgctggcgaaaaccgtcgcgcgtggcgttgcagaccacgtaggtgcagcctgcctgcacccgcacgatgcccttgttggcttgcgtgcgggaaacggagtggccgaagcggaggtcgaagccgtccgccaggccggtcgagggaagaaaccagagatccagttcgtcgagcagggcccgctcgcggtaatgatggccgaaggccgacagggtaatgcggtattcgctgtgacgcgtcagcctgaacggccccgttccgatcggcatgcgtgcgaagtcgggcttccggtgccgcggcacgatcgaggcattggccgccgcgaggcgctgcggccacagatgatcgacgtcgctcagacggcacacgattcgccggccgtcgccgatttccacgtcgagcagatgacggtatagccgctggaaatagctcggctcgccacgcatgcgcagcagcgtgtaccgcacgtcttccggttccagcggcgtgccgtcgtggaagacgatgttcggccggagccagaagtgccaaacctgtccgtcctcttccgattcccagtgatgcgccagtgccggcacgacgcgctgcgtgtgccggtcgaactcggtcagtcgcgaaaagatctgccgcaccagatgcgcttccagccggctgatcacccgatagggatcgagttcatccaccgcccgataaagggaatgcgcagacggtggctgtgcgaaccctccgtatcgatgcccaggaaatctggcagccgtttcagcaactgtcggcgctgctcgtctgccaggctggcaaacgcctgctccagttccccttccgccagcaaggccgacaggcggtcgagcaccgcgtgctgcggcggcaccaggatagtcaggcgcgaaaagtggccacggccgcgcgccgactcccagcgcagccagccttgcgcttccatcttgcgcagcaggccccgcacgttgcgttcggtgcagttcagggcgcgcgccagcgccggcaggccgggctgattccctgctcttcgagaaactcgccaagtcgatgaaaccggtcgatcagtcgcataaaagaggaaacaaaaatcgaaatttgccgtttttattgtgcttgccgttgtgcagaatgtacacgcgtataaaacaagtcgattcaaactagccttgccagaagcgggtatgcatcgttttgttgatttgtgtggatttgtaaaaatagctgaatcgaacgtcaatttccattcccgggattattgattcgatcgccattgcgtaaatatcgctgcttcaatacggcaacgccccggcctttatcaatcatcgtggatagttaatgagcgaattggattttgaatatcttccatcccgcaatacgctggttcatcaggtcgaacgtccgcacggcgaaccgcggcgggagcatttccgtttcgtccggcagccgctggcgccattggcgcccggcgaagctctggtgagaaacatgcatttttcagtcgacccctacatgcgcgaatgcatggacggcgactgggcactgcatgcgccgctcgaaggccggaccatcggccgggtactgcgctccacggacaccgcgctgcggcccggcgactgggtattccatcgacagggatggcgtacctacgcccaggtaccggtgcaggcgctgcgggtgatccggcccgcggagggtgtgccgatcaccgcgtggctgagcatcctcggcggcaccgggttgactgcctgggtcgccctgacccgcatcgtccgcctgcagcccggcgaatccgtttatgtgtccgccgcggccggcggcgttggcactgcggccggccagttcgcgaaattgctcggcgcgggccggatcgtcgggagcaccagcaacgaaagcaaggcacggcaactgatgcacggcctcggctattccgacgcattcgtctaccggcccgggcaagtcgctgcgcaattgcgcgaaagggttcccgaaggcgtcgacgtctacctggacaacgtcggcggcgaacagctcgaggcagccatcgccgtcctgaaagaccacgggcgcgcggcgctgatcggcgcggtcgcgcagtacagcgcgctgcagcctcccgccgcgccgcgcaatctgttcgacgcggtgggcaagagcctgacgctgcagggctttctcgtgaagaactacgccagcctgcagcaggaactagaggcattcgcgatcccgcacctccagcgccgcgacctcgttgcgcccgaaaccgtcacgacgggcttcgacaacatcgtcgacgcgtttctcgcgatgctctcgggcggcaatctcggcaaggccattgtcagcgtcgatagcgacgacgaaggtgcgtcctgatcctcgcccgcgggatgcggacggtaagccattgcgatctgtcacgaccattcgacttgcgttccagtaagcgaccttcgacgaacgtacaagcgccagcgcgatccaagacctgatcgacgaaggtgtcgccacgacccgcgccggacataaaccaccacccccgccgctcaatcaagataaggctccaacacccctcgatccagtccatgaaggcccggacgcgaggcgacagattgcgccgatgggccacgacaagcgacgcggcgagcggctcgggccgcaagtcgggcagcacctccaccagcgcgccgctttcaatgtaatgcgcaagcgtcggatatcccgcctggatcaacccgaggcctgccagcccggctgcatgataggtctgcacactgttgacctgcatcgcgctcggcagcggaagcgacgcatagccgtcgccgtccgggtattcccatccggcgtgcctggcaccgagtgtcagcgtgtagtggatcatccggtgtccctgcgtgcgcagatcatcgagcgtgtgcggtgtgccgtaccgcgccagatagctcgggctcgccgcattggtcatccgcagttttcccagcggccgggcaatcagcgtctcgtcgacgatcggcccgagccggatcacgcaatcgaatccttcctggacgagatcgacacgccgatcggtgctcgaaagttccagttccagttccggatgcgccgccatcagttgcgggagtgcgggaatcacgacgctgcgtgcgagctcggtgggcatgtcgacgcgcagccttcccgcaacggtgtgccgttgccggagaacatcgattgcaattcctggacttcggccagcaggtcgcgcgcgcgtgaataaaaggcgcgcccgtcttcagtcaactgaacgcgcctcgtggtccggtgcaggagcgcaacgcctacgtcccgctcgagttcacggatcaccatcgacacacgtcccttctggataccgaggctttcggccgcgcgcgtgaagctcgtcatttcggcgacacgggcaaagatcaaaagcgcgtcgaggttttgcattgttcacccagggagtaacagaacgttcaatttgtcatcgtttataactcagttgtggctcggtagagtggctttccatgtcgtccacggcggacaacgcgaacgaaaggaagcacccatgacaccacacgccgctccggtcaacacagtcgtcgtattccattccggctacgggcataccgagcgcatggcaagcgctgtcgccgaaggcgcccgcgccgtgctcgtcgcgatcgacagcgagggaaacattccagcggatgcctgggaaacgctcgccggcgcggacgcgatcctgttcggctcgccgacctacatgggcggcccgagctggcagttcaagaagtttgccgacgcatcctcgaaggtctggttcgaaggcggatggcggaacaagatctttggcggcttcaccaacagcgcaagcatcaacggcgacaagctcaacacgctcgaatacttcttcctgctcgccgggcagcacggcggcatctgggtcagcatggacatcaagccggcgaacgtgaaagcctcgatgcgtgacgacctgaatcgcatgggcgcctatatcgggccgatggcgcaaacgcctgccgatgcgtcgcccgaggaaatgtcatcggggacctcgagacggcacgccgccatggcatgcgcgtcgcgacgatcgccggacagtttcggtccggaacacctcgaggcaactgaaatcccggcatgcgcgacgggacgtgacgcaacgcaacggacgccgccgcatgccatccagccacgtttgaagggaagggtgatgaaatacaagcaactgggccgcaccggcctgtacgtttccgagttgtgcctcggcacgatgacgctgggcggcaacgccgatgccggcatgtggaaggcgatcggcgccgtcgaacaggacgaggcgaaccagctgatcgcccgcgcgcttgccgacggaatcaatttcatcgataccgccgacatttactcctttggtcagtccgaacgcatcgtcgggcaggccctccgggacatcggcgtgccgcgcagcgagatcgtgctcgcgaccaagacggccggcgtgatgggccggaagcccaacgaacaggggcgtcgcgcggccacatcatggattccgtgcagagaagcctggaacggcttcaggtcgaccatatcgatctgtaccagattcatgccaacgatcccgtcacgtcgatcgaagagacgctgcgcgctctcgacgatctcacgcggcaggggctggtccgatatgtcggcgtgtcgaattggcgcgcgggcaggatcggcaaggcgctcgggctgagtgcggcgcttcgcgccacgcgcttcgagacgctccaggcctactattcgatcgccggacgtgacgtcgagcgagaactggtgccactcgtcgtcgaggagcagatggggctgctcgtctggtcgcctctcgccggcgggttgctgtcggggaagttcggccccggtacgtcgaccgacagcggttcgcggcgcaatcatttcgattttccgccggtcgatcttgatcgagcctggccgtgcgttgcagagatgcgcaccatcgccgatgcgcacaatgtctcggtcgcccggatcgcgctcgcgtggctacttgcgaggccgcatgtcacgagcgtgattgtcggcgccaaacggatcgaacagctcgaagacaatctcggcgcggtcgatgtcgtcctgaccgagaccgagcttgcgcgtctcgatgccgtgagcgctttgccggccagctatcccggctggatgatcgagcgtcaggaggcgggcaggcgccctcaacctttccggcgcgtcgcgtcggaatagaaccggctatcgccgctcaatccagtcgaagcaagtcgttgaagatcgccacctcgcgttgaatcgcgtgttcccgttaccaaagagagatcgacatgccgaagggttatctagtcgcacacgtcagcgtttcggacccggccgcctatgctgcttatgcagaagcggcgggtgatgcaatcaaggctttcggccccaaggtcattgcggcctgggggcagtatgaaaacctcgaaggcgaggcccatgagcggcatgtggttctcgagttcgattcgttcgccgaggccaggcgtttctatgagagccccgaataccagacggccaaggcactccgcgccggcgcggcaaccgggaccttcgtcattctcgaggggcttcatgacgctgacctcgacacgttcgaacatgagcgtcgtcggttcgatctcgcggcagggggcctcacgaatcccggccgtccttcgccggaagtgcccggcattgcgaatgcggggacgctggcttgccgacacgtccttgcggtgatcaatcattcggctgaacgtccgtcggctcatgcgaccggacgagcgatggcctgacgatgatcttgccgataacctggccagattcctgagcctggtgggcttcaacgatggcgtcgagcgcgacctgcatgcctatggtcggcacataggcgccgtcctcgaggcatcggcagatcgccgaaacggctgcggacttggcggccgccgggacggtgtaaatgtagacgaaccggaatgtacagcctgcgatcatggcgtcgagcagggaagcggcacctgatcggcagcggatcctacggcgtacgaactgatgatgccgccgttggcgaggcagcgcatatcgatgtcgaggttgtcttgcagactgacttccacgatacgatcgactccccgctgccgtgttgtcgatttcacgatcgcaaccacatcctgcagccgtcgattgatcacgaggtctgcacccgcacgccgtgcggcgtctgcctgcgcgggcgttgaaacggtggtcgcgacccacgcgccggcccattttgcaagcaggattgctgcggttccgactgctcccgcgccgccctggacgagtatcgcgcgacccttgatgtcgccgtccgagaagaggcagcgatgggccgtgagtgccggaatgcccaggcaggcgccgacctcgaacgaaacgttgccgggcaaaggaacggcctgtgcttccggaacgaccgcatattccgcggccgtgccgaaggggcggcgatattgcgcttcgaacagccacacccgttcgcctgtccgtgtcggcgtgacgccggcaccgaccgcgtcgatcacgcccgcaccgtcttgatgcggaatgaccatcggaaatgcggaagggccggagaagccggtacgcgccttgatatcgctgggattcaggcccgatgcgtggatgcgcacccggacttcgcccggacccggttgcggaaccggaaaatccccgagcctcaacacttccgaagcgttgccctgacgttcgtaataagcggccttcatcgatctgatcccttgaatgagtccggtcgccggttatcggcggccgatgtaacgatgccgggactatcggcggtcgaccgcttttgcacaagaaggcacgtctttgatatatagggaaagaaattatcctattgggagccggcatgacatcttcggttagcacgtatccgtgctcggtcgccgcgacggtcgatgtcgcgggagggaaatggaagccgctgatcgtgcactatctgctgggcggtaccaaaggttcggcgagttgcgcggcttgatcggagcggtgacccagcgctcgttgacgttgcagcttcgcgagctcgaatcggacggcatcgtgacccgtacggttttcgccgaggtcccgccccgcgtcgaatacacgttgaccgaattcggcagaacgctcgccccggtgctcgacgcgatgaagcaatggggcgatgcttacctcgcgcgactggagcaatccgcggggcgccggccgtgttcgtgagtgtcccgttgcgtcgccggtggatgtccggacacccttgcccggcgagtcgttgaaaacgtgcacgtgccataattcgccggttcctgggctacccgacgcatcgtgtccttcacgaaatgattttgatcagatcttgccgccgccagcctgttgctggcgggatgtattgctgcggcgcacgccgaaacgtatccgccggaagtgtcgagaaacatcgacaagctccagtcccgatgtgccggcaaatccaacgaccccaaggcggccgcctgcatcgaatacaaggccacgctggcccgcaccgttccacccgctgtccaggagttgatgcgtcaggaagaggtggtcgatggccaatgcaggaacggcgcggcaccgaaactaatgcctgacgggcaatatgctccgggcagtgcgtgcgcacaacgcgagctgatgatgaaaaccattcgccagcacggctggtgctggggcacacggacatggatagctatcatccgggttgggtggtctgtcatcccggtgaatggcagtgaagccgggcgcagctgtcgcggaaacgcacgagtgacggcatcggcggcgttcgcggatggtcgcggattcgacgcgccgggggcgacgggtcgaggattgtgaacgatcgagcggctcgtgccgaacggccgccgcattcgcagacattgaagagccgtaatccgcaatgcacgcagaacgtggagtcgtcgccgccgagattccattgtttgtcgcatgacgggcagcgctttttcgagcgaacgaacggctttttcgtagccgatcgtgcgcgcgcgttctcctgatcctgctgcaattcgagccgtttgcgttcggcatagcgctgaaaggccttcatcatgtaaaggccggcgaacaccgtgagcgcaatgcccaccaggacccggacataaccgccgaaattcggcaagtgcggaaccagttcgatgaagaacgcgctcagtgcaaacaggccaaaaccgtacacgaaaggccagtagcgtatcttgcggtagcgtatgaacaaccagatcgcaaccagcagtatcggcagcgtcagcgcaagccgtagcccgaacacttgcaactcgtagtgccgtgtcgcttcgtcgaagcgccgttcggctgctgcgtccgcttcggcgatttgcgtgtctacttgagtcagctgcgatgcgagcgcccgttgctggtcgttgatcgcatcgatctgatgctgccagttgaccaccactgtctggagcgaatccagcttgcgagttctcgccagaatgtcgggatcccttgcactgtcgccggtcaccgagcgcgttgccagccagttgcggaagctttccttctcggccgcatactccttcgcggcgcggccgcgcgcgacctccatggtgtcggccttgtcggcaagcgcgttgtgctgtgcctgcagattgcgccgcgctgcgtccagccgcgctttcgtcggcgcatcggcgaattgctcgatgacgggcgggccgcccgtcggggcaaacgccatgtcgcgaatcacgaggctgccgagcatgttcagaaagacggcgaagatgatcgcgattacccatgaggcgagtcgcaggagccgcgcgggactggtcaggccgtcgccggaagtcatcattgttttgccttggttggaatggttcgcagtgttatcaatcttgacacaatggtcgactcttttggccggctggcgcccgatgcggtcagtaggaatgctccaaaccacgcagcctttaacgttggctcagacgaaacgtcgggcttgcaaggcggtcatcgcggcgaatccaggccgagttgctccaccagctcagggaagccaagcgacgttgccatcctggcaaaggcatcctgctctgtcgtcgatgcaactgcaagtgccgttgcgatctcctcaagtgcgttgacgtcgtcgtcctcggcatgcaagttactctgttgatcgatgtacctcacggccagtacaagtgccttggctattccatccatgtcgccctcaaaaaccaaatgcgatgtgaaccatgtgtacagaaaaggtcgctgctttgacaaatttcccatgtccgcagtcgcgagccgtcgattctgtctgtgtcacgaagttcgcgtcttccttgctttccgcttattgacgatcctcagacggagatatcgaacgtccgacagtggccgaacgtggtccgacgaagaagattctgccgtgtcgacggccgccgcgggtgcccattcatcgccaacgttcaactattggaaccgtcacgaggttcgcatcttcacgctgtggcgattaacttgttccttgtggatgtcgaaggtgcatcggtcacctgtcgcggctatcaggcgaaacccgcatttttcggcgacgcgaagagaggctcgattctcgatagcgcatgacgccgtcaagctcgtcatcctgcccgagccgaacgcgagaacgagcagcgcacgaatcgcatgagccgcgtagcccttttcccaaaagtcaggcaacaaaaaccagccacaatcagccgaaaccgagtcgccgatcgttgctgtgcgatcgcgtccgccaacgcatgttcacattgcgctctcgttcgcgggagccacgacacgtagcgggccacttgcgagctcatctgcaattcgcaaaatcgctcgatgtcggacggcacgtgctcacggagtcgaacggggcatgaattcattcaggtaccggaagcagcggggcgcatttctggaaaggagtcgtacgcggtcacggaatcatcaaggcccgggcagcagatgcggaagcgacggaaacctcgacggcaacgagcacttcgagagaacggcgcgctgcttctgtctcaacgggctggtgccctgcgatgcgagccaggatacctcgcttcccgctgccattcgggccccggcccgacatcggataggagcgcctgccgtcaacgcgtaagcgctcccgttcgacaccaggttttcgtctgatcgtggatcagcgtcacggcgcggatcttgctgacgcggtgtcctcgggccagttcctataagggtaagtccggcatggcgcaacgttatcaaaccagattaacttatatcaaacaatttttgacgcaaaattatgttcctgatatggtctttcgcacttgctaagcgcgatccggccacgttggcgcccggcgattaggttcgcgtacttcgccagcggttgaaccggacgctcaagcagcctgtaatggcggccggtacttccagacggtctttgtagcaggtggagcgtggtccggtttcgtcatcgccgaccttgctcgcaggcattgcacgggcgcggaacgtgacgacgccgggctgctccgaaatgccatcggggaaggttcggctgagcgcggtgatccgctcgagttgcccggcttcgcagattcggcacatcggttcgccggatcatgtgaatacggcgggaggacgtcagttcgaatgaatcctctagtgcgcgctcgtggccaaggcgcgcccggaaatcaccgcgcagggggcaagtttcttcgcgtgatcgacggtgaagtttcgccggagctggaaggcaaggtattgatgcagcaaacaggcgactcggcacattctcgatccacggtgccgtagggctggagcgacaacggaagcaaggaagcggctttgatccaggtggggacgccgcgattgttctgatcgaaagagtgccggacaggtcgagatgcgcgatgcttctccgcatgcaattttgaggatgacgaaatgattgatttgattatgccgatttggcgaatatgacgctggccgttgcggccgagacgacgcgcaggccgtgcgccgccgtctgcattcgaatacgacacaacccgtttcaaacaatcccaaaaccactcctgacagtgaaatacagatgaaaaacaaaaacatcaacgtcagcgttatcgctgttgccgcattcgccgcatcttcggcagcaatggcgcagtcgtcggtcaccctgtacggcatgctcgattcgggtatcggctacacctcgaacatcaatggccacaagcggttcggcctcgacgggggcgccgtaggttcgaacaagtggggcctcaaggggatgaagacctcggcggcggcctcaaggcggtattcaagatcgaaaacggtttcaatatcggtacgggcggcataaacggccaggggccgattggtgccacgcgttcgttgttcaaccgccaggcatacgtcggcattgcttccgatcggtacggtacgctgcgcatggggcgccagctcgacgccgtaacggaaatggtgcagggcctgacgggcgacgccatttcagcgtcgacattctcgaccccgggcgacgtcgacaacaacgacaacacgacgaaccagaacagcgccgtgaagtacatttcgccggtcatcaacggcttccaggctgaaggcgcgtactcgttcggcggtgttgccggtgcgatgggttcggggcaatcgtggtcggtggcggcgaactacgctcaaggcggcctgaccgtcgccggcggttacttccgtgcggccaaccagggtgagaacgggtggcagaacgcaacggcacaaccgggtttcggtaccgcgctgggctatccgagctcgggttataacggtggcaatgcgttcaagagcgcgggcatcgcccaggtcgcaactcaataccagatcggtccgtacacggcgggcttgcggtactcgaacgcgcagtatcaaggcaacaatggccagccgtcgatccacttcaacgtgctgggtgcgctcctgcagtaccaggtcaccccggcgttgtcgctggccaccgggtacacgtatgtctacggttccgcagccacgcccagccaggctgccgaaggccgcacgatggcttcgatcaaccaggcgtcgctcggtgccatgtacgcgctgtcgaagcgcacgtcggtttacgccgtgggcgcctacgtccatgcccagggcgctcaggcgtcggctgccgactttggcaacacctcatcgggcggtaaccaggttcaagtcaacatcggcatgcaccatagcttctgatcttcaaattgcaggcccggaagcccggagtagtggacgcactacgccgggctggcagcattccggtggttccacatgaccatgagcgctcggatcgtcaaccattcgagcgctcgtgtcagacggccgcaagcggccggggcgcagctggccgcccgatctcgagtctcgtccgcgaatcgcccggacttcacggcagccgtggacggcttccatcccgccatgagcgccgccgccggtccatgcgacgccttgtcacccgcgtaacaaaagccctgctgaagccggggtgtctcggccgcattgacggttcacccgtcccgcagccgctcgacttgccggcgcgcagcacgaacgtcgtcacggcactcaactcttccaagaatctgtcgttaactcagggcggctgcctccgagtgggcggcgctccggcgtctgaacccgctggacaagggatcgtcaaatgcgacgtcgcggcccatgtgccacgctcgccgccgcgacgcctcacacgatgggtcaatgccccgtctgcgagttcgatgagtacgcaaccattcgaggcaagcgagatcgcgccgcgcctgtcgccgcgggcaagcctgaaggttgccgggtcgaagcgcgccggcgagggcttttcgtcttggttagagaatgtatccgagcagctacgatgttccgattgcgcgcctcgtcgcgcgtcagattctgtcctgcacgcccgccacgccggtgcgggaggtcgcgcgacgcatgttcatcgagcgttgcagctcgatcgtcgtgatggaggatgaacaggtcgtcgggatctggaccgagcgcgatgcactgtcggccggcgacgatccgcacgggctcgatcggccggtcagcgaggtaatgagccatccggtgctgacgctcgaggccaacacgccgctgggtgaggccgcgatgaagttcaagcagtcgggcgtccggcacttcgtggtggtccgcgataacgccgcgatcggcgtgctgacgcagaccgacgtcgtcgtgaaccaggggccggagttcttcctgcacctgaagccgatcgaatcgatccgcgtccatccgcccgtcgtggtgtccgagcaggtcgcgctgcacgacgtcatcacccggatgcgcacgcaacgactcgatgcgatcctggtcggctacgacgacggcgagcacggcatcctgaccgagcgggacatcgtccggctcctggcggaaggcgcgtcccagggcgcggtcggggtctacgcgagcaagccgctgcagatgctgagcgcgaagcagagtttgatacagcacagcgcttcatgaccgagcacaatatgcggcacgtcggcattcgggacgaggcgggcaggctgaccgggctgctttgtttcgcggacgtgctgcagagcatcgagcatgaatacgcgaacgagttgcgcagcgccgtgcgcgagcgcgacgaagcgctgggtctcgcgcgcttcaacttgcgcatggcggatcgggtattcgaatcggcgctcgaaggcatcatggtgaccgatcggcacgcgaggatcgagcgcgtcaaccaggccttcacgcgcctgaccgggtacaccgcggacgaagtgatcgggcgcaacccgggcctgctgagttccgggcgccagacgccggatttctacaagcagctgtggcattcgctgacgaccgacggtcactggcaaggcgaaatctggaatcgccgcaagaccggcgagctgtttctggaatacctgacgatcaccagcattcgcgacaacgacgacgagatctcgcactatgcggcgatcttctccgacatcacgcaacggcgtcaggcggaggagcggctgggctatctcgccacgcacgacgtgctcaccgatctcgcgaaccgggcgctgttcgaggagcggctcgcgcacgcgatcgctcacgcgaagcggctcggtcgcaaggtcgcggtgatgtacctcgatctcgaccgcttcaagctggtcaacgacacgctcggccacaacgccggcgacgaggtgctgaagcaggtcgcggagcgcatcgtcgcgtcggtgcgcgcgaacgacacggtggcgcgcatgggcggtgacgaattcgcgctcgtgctcgaggaattcgacgatgttcgcgacgtcgggcgcgttgcacgcaagctgctggacgaagtggcgcgggcgatcgatgtcggcggtcgcgagatcttcgtgacgccgagcatcggcatcagcatctatccggacgacggcaccgaggcggagcacctgatcctgctcgcggaccaggcgatgtatggcgcgaagagccgcggcaggaacgtgttccagttcttcgagagcaagatgacgtcgtcggcgatggagcagctggagacgctcggcgagctgcaccgcgcgctcgagcagaacgaattccggctgttctaccagccgcaatacgatctggccagcggccggatcgtcggcgtggaggcgctgctgcgctggctgcatccacgcaagggcctggtgccgccgggcgacttcatcggtctggcggagcggtcggcgctgatcgtcccgatcggccggtgggtgctgcgtgaagcctgccgacaggcgcgccgctggctcgacgagggtttcgagttcgggcgggtgtcggtgaacgtgtcggcgcggcaatgctttaccgaccatttcctcagcgacctgacgaccatcctcagcgaaaccgcgctgccggccgaatgcctgcagctcgagttgctcgaaagcatggcgatgaacacccgcgaggaaatcggcatcctgctgcgcgagttggcgacacggggatcagcctggcgatcgacgatttcggtacgggctattcgtcgctggtatacctgaaggatctgcccgtcgacacgctgaagatcgatcggtcgttcctgacggactgcggttcgggcagcacggatgatgcaatcgtgcgcgcgatcgttgcgatggggcgcgcgctggggctcgatgtcgtgatggagggcgtcgagacggagaagcagctcgcgttcctgcaggaaatcggctgccaccaggtgcaggggtttctgttcgcgcggccgcagcctgctgaacagctggccgggatctcgtcgcgtcgcggtgttgagttgctgaccgagtgaggcggtggggtatcgatatgtcagcagccgaggtttccgcgatcgcgctgctgccgcttttgaacgacagcatgtccgtcaccttgccggtataaaaatcgacgatttcaccgccatgcgtcagcagccggtcgccgaaccaatctgctgccagtcgcgcgggcggcccacggtgacgttgaatggcatgttcgatcgcaccggtatgtgcgtcgatcaccagatcctcgccccaattgcagcgtgccgtttccggcaagggtaagcacaaatggctgccactctcgttgaacaggatgttggccgagcgaacctcgccaaattcgccaatatcgcgcgaccataccaccgagccattccggtcacagcacagcaattgattggtatcgctcgcgacgaacatgactgacccatcgcgcgcaaagcgcaggcgcttgaccttgccgcccgccgggagattgaccgtgttgatctcgccgctgcggcaattcacggtcagcaccgaattcctggttcgtttgtctggagcccacaggagtccgtcgaccggatccacgtcgccgaaacgtgcatcgaaatcgcgcgcgacaggatcgccaagctcgcctgtgtccagatcgatcaccaccggacggcctttgtcattgctcttgaagacgcttaccagcgcatagcgcccggaaggatccaggcgcgtccagaacgacagaaacctgtcggtctgatgcaggacggtgccatcggcaactacggtcaagcggctacggttggtattgcgtgcgactatccacgacgccgatgccaatgcaaggcgacggccgtcgcgcgatacatcacacaccgtatcgtccgtctgcgcgccggcgatcgatgtaatcgttttcgaatcacggtcgtattgcactaacgccggctcgggaaggaaagcgtcagtttggtcgaagaacacgagaccgcggggtacatcgatgtacacaagtaactccggcaagaaatgcgcaaaagacgtgtcgatcgcgattgtttgggttagaagtgacgccttgagtcggcggatcatgtcttgattatcaacagactggcacgtggcgtcgagcgattggtcgtgggcggctggtcggagctggttgaccgtggtcgacccatcccggtcactcatagatcgctaacgtgagtctcctttcggcgaaatacggtcatacttcgaaactgggcgacgcggagccgcgacgcattgcgcgacacatcgccttaaaaaggccgaggactatttcgtgggtaaatcgcatcgtaatcatcactttgttccaagattcctacttgaagaatgggccggcgcggaccgcaagctaacctacttcaactggcgacgagacggcgaactgcacgtcggacgctgggcctcgcggcgtcggcgccgaagagcacctgtattcacagcggcaagcatcggggagatggaccctgaaatcgaggtcgatgtcttcggaaagattgtcgacacacctggctcactggtccacaagaagctcctcgctggcgaacttaaccgattgacgactcaagaggagaaggcttggagcaatttcctcgtggcgcagatgatccgcgtgccgtcgatggttcaatacctccgtgataggggcggcaacttctgctccgagacatagaagggattgagccgcccgatgacattaaagagcagcttgggcagttgacgctccagcaatatctggaatccgatggggcttggctgcttgataacgcgtcgctgcgtgctctgcaagtgattatcgaatcgcaaacgcttaatagcgttttccttggtgccacatgggcggtgtgcgacgtcagcgattcaaatcttaatctcgtaattggtgatcgcccactgctacaggaagggaaaatgagcgagcaatatcttttcatgctcccgctgtcaccaaccatcgcgtttgtggcctccaaccaggtgcacgctgtgcagaatttgtcagccgagaagtcgcggaatgtcgtcatgacgttcaataaagaggcaacccaagtagctgacacgcatgtttacgctacgggccgagagcaggagtcaatgatcgctcgataccttcgcaaggcgaccgcgcctgacgatcgacacgttgtctcgggcctgagagaggccctggctggttaagcaagctatacgcagtgtgagtattggactgttaagcatgccccagcagacagcggtcacggtggagtgtcaggaagcactaccaaaccggactgtcaaggcgagggttgaagtgtctcttcatggccggcaagcgaccgcttgccggccgtgatgccatcaaacctccgtctgctccgccatctcaagggcatcgtcgacctcgatgccgagatagcgaaccgtactttccagcttcgtgtgtccgagcagcaactgcaccgcccgaaggttcttcgtccgccggtagatcagcgaagcttttgtgcggcgcatcgtatgggttccgtatgcagtatcgtcaaggccaatcgatgcaatccaacgatgtaccagccgggcatattgccgcgtcgacagatgcggtgacgtgtgcgaccgactcgggaacagaaaatccgctgccttcagtcctcgcgcttcgatccaagcttcgaggctctcacgggtctgttccgtgatctcgaattgcacaggccgctgggtcttctgctgcatgattgtcgctctggacgccacgtggcttccgtggcggacatcttgaaccagcaaccgcgtaagatcgcacgctcggagcttgctatcaattgcgagattaaacatcgcgagctcacgaaggttcggcgccatttgaagtcgcgtccgaatcgcccagatttctcggagttttaacggcggcttctgcccggtgagcttgcccttgttccatggcgcacggtcacgaacgacgacattctcggattccatgacaatctcctttcaagcaaagggagattgagtgcgcgccttatccggcgggcgctatcgatccggagcagccgctcaacgaaatacacttccggggtccgctcctggcgcacaggagccattcgtcgaacctgaacgccttcaatgtctgtcacgtcatatcgccgaaacgcaattgcgttttgaggtagttcagaaaagcttgcagcttgggcgagggaaccagctctcgcggaaacagtgcgttcaaatcctgcggtggacctatccattcgggcagcactctcagtaagcgccctgcctcgacttcgggagccatgctggcatccatagccagcaacaagccttttccggcgcgcgcggcgtcaagcataagtgcggggtcgctggcgacgatcaccggttccagcgcatagtgagtcgccttccgtcccggcttgcgcaggggccaggtatagccgctgtcgctacgagcctgatgaagtgcgagcgcaggatggagccggagttcatcgggaacggccggcgcaccgtgccgttcgacataggcgggactcgcatagaccgacgtcgaaaaagtcccgagccgccgcgccacgagactggaatcgggaaggacgccaagacgcagagcgacgtccacttcgtcatcgaaaagatccaatggcacgtgcgtcgccagaatatcgagccgcacatcgggatagcgagaggagaatccggcgatcaatggcgcgatccacgtgacgccgaacgaatacggaagcgtcacgcgcagccagcctgcgggcgtgccgcgaatacgctgcacggcattctctgcctcgtcgagctgtgtgcagatagtgcggcagtgctcgaagtaagccgtaccggcctcggtcagacgcagtttgcgcgtggtccggtgcaacaggcgcgaaccgaggtgcgcctcgagttcccgcactcgccggctgaccgtcgtcttgggaatctgcaacgcgatcgctgccgcagtaaagctgcctgattgcacgactcgaataaatacaagcgtgtcgttgagatccctggtcatcgacggcaatatccggactgagcatttgttgatggcttgagcctagcatagagattgtgccgctgatggctcaatctttgccgtaagaacgggctaatcaccagcccgcgcctgcaatatcttgtcgccttcaacctggaggcgcacatgaatctcagcgaatacgcaagtcacgatgcaattgggcttgcaaaacgcgtgtcggaccgcgaagtcacgcctgccgagcttgccgaactcgcccgttcggcgatcgaggccgtcaatcccgcgatcaatgcggttatcgagcactggccggccagcgatagcggaggcaacccggaacactgcactggtccgcttgctggcgtcccgtttctgatcaaggatcttgcggttgccatgagcggtaagcggctggaactcgggagccggctctccggtgacgttgtcgccccggccgattcgtggctcatgtcgcggttccgcgccgctggactcgttacgattggccgcacgactacgcccgaaatggcgttcagcacgaccacggaatccacgctccagggtgcgacgcgcaatccctggcagctggattcgagcgccggcggttcgagcggtggcgccgccgccgccgtcgcagccggcgtcgtcccactcgcgcatgctaccgatgccgcaggctcgatacgggtgccggcaagctacaacggcttgttcggactcaagccgacgcgcgggcgcagctcgaacgggccagccctcgacgaagtcttcgcaggatttggtgtgcaacttggcgtgagctggagcgtgcgggacagcgccgcgctactcgatgcgatccaggggcaggcgatcggcgagccttacctgaccgctgcgccggagtacagcttcctgtcgcaggtcgagcgcgaacctggcaacctcaggatcggcatgatgaccgatccgtggagcgcggatcgaaccgacccggcaatcgcgacagcggtggaatcgacggcacgtttcctggaagaactcggtcacatggtattcgaagtacggccgtcactgggtgtctcgtgggacgcgtttgtgcagatgaatgcgacgatctggacggcgacgctggtcggctggatcgaaggccttgctgccgcaacgggacgcccgatcgatgagacgacgctggagcccgccacattggcctgttatcgctatggcaaggaagaaaaggcgtccgcattcgccgccgctctggcgatgcgcaacgttgtgacacgggctgtcgggcattggttcgaagacttcgatgtgctgctaacgccgacgctgccgcaaatgccaccgcgcattggagagtacggcgagggcgcggaatcgatgaacggcctcgaatggactcagcgagtattccggcattcgcctcttaccccgccgttcaatgtcgccggtgttcccgcgatgtcggtgccgctagcaagtcatcccgaaacgggtctgccgatcgggatgcagttcgcgggagcattcgcgcgagaagataaattgctgcgactcgcagggcagctcgaacgcgcacggccgtggatcaatcggcggcccgtagtttgggcgggacgtcaggagtaaccgcgacaacgagtgcgtttcatgcgggcggctcggtccgcccgtctttgcctgcgctctcacgcaaaggtaacctgccgccgaaccgtgaacatctacgcgttcatggatgtcgacgatcttgctgctgatgtcgaacgtcccttcctgcggcggcagccgcttgctctcccagcacctggccaaagattgttgaacgtctctataacccttcttgcgcgaacgtgaccgattcgctcgcaatcggcgtttaacccggaattcatcaccagacgaattcgtgcgatagcaggtcaccaaacgcattcagaacgtgtgctcgtaattcagtcgaacgtgaaccgtgtcggcactgctatggcgaatgtgcttgacgaaggtcaaccaggtaaaagctgaccgcgcgaaaaattgccgtgtacgagatcgtcggttgtcactggggacattcatgagcaccaccacatcacccgtccaggccgtccccgctctgcggcgggtgctgatcgccgtcgacggttcgaccgcatccgcgcatgcactcgcgtatgccaaagcgttcctcccatcgaatgcggcggtgcacatcatcagcgttgcggaaaatccgagaacgctcgtcccgctcggatcgaaaaccatggcgttcctcgaatccgcgcgcgtcgagttgctcagggatgcatctgatgcggtgtcgcgcgccaaagccgcaatggatcgcgacgatctcgtcatcgacacggaagtcatcgacctcgccacacgaggcggggatgtcgtgaatgcactggccgacagcgcgcaaacctggcaggccgaactcctgatcgtcggcgcacgtcagcatcatggcttgctcggatgggtcgaagggacggtttccggcccgctcggcaaactcatcggatgcccgctgctcatcgttccggaaggtttcgcgtcggttgccgagcatctgccacggcggatgctgttcgccgttgacggaagcgcgatcgcactcgacgcattgcggacagggttgacattctcgcgggtcgacaccgaattccgtgcgatatacgtggttgatcgcccccaatgctcggcgactttgtccttggcggggcactggaagaagcattgatcggcgaaggagatcatgtgctccagggtgccacggccataatcgaaggcacggccagacatgcgcagtcgcaacttgttcacgcagatcgagccggcgcggacgtttcccatctgatcgtgcgcgacgcgctcgaatggaatgcggacatgatcgtcatgggcactcacgggcggcgaggcgtgacgggctggctcgtcggcaccgtggccgggcgcgtggcgcgcatcacgaaaactccggtcctgctcgtccatgcgtcgcgtgcgtgacgcgcttcgtcgtcacgcatccgcacccacggcgtggaacagttcctcctcctgagcgcaatgcaggcgcacgatcgcttccagcccgtacaacaagcgctgtatcgcctgcacctgcatggtgttcgtgccgtcgcgcggcaggtccgcgaccatttgtctgagcgatcggaccatcttgaagatctcccggtgcgcgccgctcatcgcagccagcgggtcctctccgccgagaagcggggcaaggcgcgcgtagacgtcccgatcgtcggcgcgttcgtgcggcagcagccgttcgtcgagcgagtcgatcatgtggaccagctcgctggcgatggcggccccggatagtcccggcagacgatccgcgagatccctgatctggtccagcaacggtgacaatgccgtgtgctcgcgcctgagctgctcgacgtcgacatcgtcgagccgggcgttcgtcggcctcgggcgatccagcaacacgcgcaacgcattgacgatgacggcgacgtcgatgacttcctgaatcaccgcgccggcaatcggttgcaggaatccggccgccgcaatcgtcatcgcgacgaccgacagcgacatgccggccaccacgctctcgagtgcgattcggcgcgaccgtcgcgcgatacgtatcgcatccacgagtcgatccagccgatcgaccagcaataccacgtcggccgcttcggatgacgcggccgcccccgcgcacccatcgcgataccgacgtcggcggccgccagcgccggcgcgtcgttcacgccgtcgccgaccatgatcgtcacgccctccttgcgcgcggcctgaatcgcgacgagcttgtccgtcggcgtctgctcggcacgcacgtcggtgacacccagcaactcgccgacggcctgggcgatgtcccgccggtcgccggtgagcatgacgaggcgctcgacgccttcgcgcttgagcagccgcaatgctcgcggtgtttccagccgcacctggtcggccatttgaatcgcgccgatcatgacgccatccgcgccgacgaatacggcagccccgccctcgctgacgacgcgtgccaggaatgcgccgctccacggcgcattcgtcgcgaatgctgacacgtattcgaacttgccgatcgcaacggtcctgttgtcgacccggcccgtcacgccttcgccggccgtttcgatgacggccgacggcagcgacaggtcgatgcaacgttcgtgcgccgcgaccgtcagcgcgtccgagatgacgtggcccgacgcttgggccaatgacgcggccaaccgcaacacatcgtccgctgcgacgtcagcgccgcactcgatcgcaacgatgcgtgcacgtcctcccgtcagcgtcccggtcttgtcgaagaacagagttgtcgcttgtgcaagacgctccagcgcaccccgcctttgaccagaatgccgcgtttcgaacaacgcgacatgccggatacgatggcgaccggcacggcgaggatcaatggacacggcgaggccacgacgagcacggcaagcgcacgtgtgacgtcgccggtcaacagccatgcgattcccgcgacgagcagcgatgcgagcacgaagaatgcggcgtagcgatccgcgagacgaacggacgggctgcgctcgcgttgcgcacgctcgaccatacggacgatgccggcaaacgtgctgtcgctcgccgtcgtgcgggcaatcatttcgaaaggggcgcctgcgttgaccacgccgctgcatgcgttttcccggaacggcgtcgcagggtggacgattcgcccgtcagcatggactcgtccagttccgcgtcgccggtcaatgtgccgtcgacgggcacgaactcgccgctccgcaccagcagcctgtcgccggggacaagggtgtccggcgcaaccgagcgccattccccgttctcgaaacgggttgcctgccgggggcgcggccgagcagtgcgctcatctcgcgttgcgcacggtcctgcgcataccgctccagcgtccgcccgctcgccagcatcaacgcaatcaccgccgccgcaagcgtctcgtcgagcacgaccgccagcgcgatcgcgagccacgcgagcacgtcgatgccggcctgccgcctcatcacggccttgaccagcgagaccgtcaacgcgagcaggaccggcagcgtccccagcagccaggcgaatcgtgcgagcgacggctggccgaacgccacgcatacgccgccgccggcgagcgtggcggccgccagaatcagcaacacgagatcgatcgaccaggggactcgggacatggccattgctccgatcgccgtgcatggtggtgttcgccgcatccggtttcggttgcggacggcgtggcatcagtctaggaagcgccgcgctttgagcattgacatgggtcaggacggcgtgcctcccgtgaacgaccggcacgccgcgttgcttgacgtgagtcaagccatcggcctctttcctcagcaaaattgagccgtgacaccggatggcctggagtcgatatcgtgctgacgctggctgtactcttcgtgctgattcttctgctgaatctcatgccggcgttcgccccgcccacgtggatggcgatgtcatgggtcgggttcaacctgcccgacggcaatccgttcatctttgccgttgtggcggccggcgcggcgacgaccggccgtgtcattctggcgaccttcgcgagagcgctcgtccactcccgctggatgcgggaatccgaccgcgagaatatcgacgtcgccacgcgctggctgcgacagcaccggaccgtcaccgtcggcgcgttttcttctacgcgttgagcccgctgccgtcgaactacctcttcattgcatacgggctttccgggttgccactcagaatcatcgcggcggcgttcttcatcggccgcgcaacgacctatgcgatctgggcgcatctcggccgttttgcatcgacccggctggacgtggaatcagaactcgaaggcacgtatctcggcggctacttcgtcgtcacgcaactggtcttgctcggcctcgtgttcgcgctgatgaagctcgattggcgggcgctcgtcaatgaacgccggttgactttcagacgcggccatcatccgcgcggttccgattgacacgcggcgcacgcaatctttcgatcgggtgcatcgtccagccgcttccggctaccgaacgcgcatcccggaggcgacctcggggaggctctcggggctccgtggatcgacgtgcgtcatgccattcaggacaccgtgatgcttcattacgcgcgcacgcgcgtccaccgcaatgtcgtgcccttgtgcgaccgtaagatcagcgtcgatgtcgagatgcacgtccacgaggatcaagtcgccggtccgacgggggtgagcagcgggtagccgaacaggttgccgacgatgccggcatccggtgaaatagccgtcacggctgcgtcggcgcacacatacgtcacgatcagttgccaccgggtcgagggcatcatgctattcgttattctgaaacgtgtcggcgacggatttgaaaatggctgccgcattgaacgcccgcgcattcccggcaaaaacttgcacctgaatgaatacctcgcggatctgctcgaccgatatgccgagatgcaaggcagcgccagttggaaacgcaattgattctcgcggccgcccgtgacactgattactcgaagcgtgacgaggtgcggcgtcttcagatcaatgccgggccggcgatacgcgtatccgcaaatgtccagactctttgcgaatcgcgcgaactgcggggctatattttcgggtaaacaaagtctggtaaagaaaaatattagagcgcgtcacgcagcggttcgcacatccccggcagcgcgaggggcgtgacagggagtggagtcgggattctcgcccacgtcatatcgatgacagaaatcgttgtttgcgggtacatcgtgcggcacgctagattggccgaaccggcgtcgatgcctgcccggtgcacagtcatgctcgacgcggatcgacgtggaggccgaagtcgatgagccgcgacatggtgtctccgcccaagcgggattgcccctgcgcaaagcatcccgccgcacgtttccggtgaccgggtggcgttgcgcacatggcgccgctcgcccagaggcacatcttttcgacaccgcattgacgacgacttcatccaatctccgagtagaccgacggcatcgcgtcgcgcggccgctcgtcctgacggccatcggcgtgtcgaagcgcttcggcgcgacgaccgcgctcgcatcgctcgacctgtcgatcggcgccggcgaggtcgtcgcgctgatgggggccaacggcgcgggcaaatcgacgttcgtcaagatcctgagcggcgtgatccgtcacgacggcggcacgctgacgctgcgcggcacgccttaccggcccgcgtcgccgcacgcggcgaagcagctcggcatcgcgaccgtgcatcagtcggttgccgacgcggtggtgccgacgctgtcgatcgccgacaacctgctgctcgaccggctgtgcgatccggcatcgccgtggcgcgtgccgccggccgcccggcgcgatgccgcacggccgctcgccgaacgcgtcgggctcgatgcagacctggcggcgccgcttgcgtcgctttcactggcggaccagcagcgtgtgacgctcgcgcgagcacttgccgggcagccgggcctgctgatcctcgacgaaccgaccgcgagcctgtcggcgccggaggccgagcgcctgttcgcgctgctcgatacattgcgtgacgaaggcgtcgcggtcctgctggtgtcgcaccggctcggcgacctgcgccgtatcgccgatcgcgtcgcgatcgtgcgcgacggacggatcgtcgccgatctcgccgcaccggtcgatttcgacgcggcggtcgaaacgatgctcgggcggccgttgccgaaggcgcgtgcgccgggcccggcgccgatcgcgcggcccggcgacagcggcctgagcgtgcgcgggttgcgcctgacgcaggccagcgcgccgttcgatctcgacgtgcggcgcggcgagatcgtcgcgatcgcggggcccgtcggcggcggcaagtcgcgcctcgccaacacgatcttcggcaccgtgcgcgcggcgcagggcgcgatgacgctcgacggcaggccgtggcgcccgcgttcacctgccgacgcgattcgcgccggcgtgttcctcgccggcgaggaccgctggcgcacgtcgctgtttcccgacagcgtgccgtttgcgtcgatcgcgggcaccatcagcttcccgttcctgtcgcgctggttcggcggcggcgcggtgcgcgccgcgcacgagcgcacggcggccgccgccgcgatcgcgcgcttcgggattcgctgcacgggccccgacgaccgtctcgtgcggctgtccggcggcaaccagcagaaagtcgtgcttgcccgctggcacgcggaacccgcgcggctgctgctgctcgacgaaccgttccagggcatcgacgccggtgcgcgcgccgatatcgtcgacatgttgcggcgccatgcgcacgaacgcgcgacgctcgtgttcgtcagcgatctcgaggaagcggtcgaagtcgccgatcgagtcgtccggttcgatcgcgcgacgctcgatcattcatcctcccacccgtcggactgatccatgacgatgctgaaatccgccacacctgccgttgcacccgatgcgccgtccgccaggccggcgctgcccgcgtcggcccgcctgcgcgccggcctcgaacgcaccggcatcctgctcgtgctcgccgcgctggtcgtcgtctttaccgtcaacgagcccgcgttcctgaaagtggacaacctgttcagcatcctgcaggcggtgtcgatcgtcgcgctgctcgggatcggtgtgacgatcacgctcgcggcgggcggcttcgacttgtcggtgggcagcatcgccgcatccgcgcagatggcggcgagctacgtgctggttgtctggcacggcagcgcgttcgcggcggtggcggcgtgcgtggcgctcggtgtggcagccggcctgttcaacggtgtgctgatcacgcgcttgcgcgtgccggaccagcttgcgacgctcggcacgctgttcctgctcgcgggcctgcagttgattccgaccggcgggcgttcgctcgcgaccggttcggtgctgcccgacggcacggaagcgagcggcatgtttcccgacgcgtttctcgcgctcgggcgcctgcgcgtgttcgacgtggtgccgttgccggttctgatactggcggcggtgacggtgctggcttgcatcgcgatggaagcgacgcgctggggccgcgtgatctatgcgatcggcggcaacgagacggccgcgcggctggccggtgcgcccgcggcgcgctaccgggtcgcggcgtatgtcgtatcgggcgcaattgcggcattgggggcgtgctgatctctgcccgcgtcgggcgcggcgacgtcagcgccgggcactcgctgctgctcgacgcggtggccgccgcgctggtcgggtacgcggtgtggggcgcgaaacggccgaacgtgttcggcaccgtggtcggggccgtgttcgtcggcgtgctgctcaacggcctgacgatgctcaatgcgccgtattacctgcaggatttcgtgaaaggggcgctgctggtgctcgcgctggcgttcacgttcggcatcggccggcgcgcggacgccagcgcctgaacgcggtgtagggaggcacggcgtgcggcggctcacgcggcgcgtacacgccgccccatgaaactcagcgcgagcaccgcgaggatcagcgcgccggtggcgacctgctgccagtagaagttccagccgatcagcagcagcccgttggcgacgaggctgatcagcagcacgccgagcagggtgccggcgacgccggggcggcgtgtcggcgacagcgtcgtgccgatgaaggtcgcgccgatcgcgttcagcaggaagccgttgccggcctgcggcacataggccttgaccgtcgacgacagcagcaggccgaccacgccgtagacgagcgcgctcgcgacgaacgtcgccacgacggtcgccgcgaccggcagccccgaatggcgcgcgacgcccggctgcgcgccgagcgcggcgctgtagcgcccgaacgccgaatgcgcgagcacgacatgcacggccgcggcgagcacgacgacgcaccacagcggcaccggcacgcccgcgagcgtaccgtgcgcgagcgcgccgaacagcggcggcagcgccacgttcagcaggtagacgggctggccgccgccggtggcgagctgctggacggtctggccgatgaacagcgtgccgagcgtcgcgagaaacggtgcgatcccgaggccggcgaccagcgcgccgttgaacgtgccgaccagcaccgccgcaccgaggccgccgagcagggccggcagcacgcccacctggtgcgcgaccaactgcacgaacacgaggctcgcgacgtcgatcgcggtgcccagcgacaggtcgaccgcgccgatcgacagcgcgagcgtcatcccgagcgcggcgatcgcaagcagcgcgaagttgttcaccagcacgtcggcgagattggcgggccgcatgaaccccggtgcgaacacggcgaagaaggcgatcaccgcgagcagtgccgccacgagcgagaaccgctgcaggcggccgatccgatcagtcatgggcatggtgttccgtatggcggcgccgaatcagcgcggtcgtcgcgacgacgaacaggatcagcgcgccttcgacgccgttgacccagtagctcgacacgttgtcgagctggaagccgttgccgacgatgccgacgaacagcgcggcgagcagcgtgcccggtatcgtcggcacgagccgccgcgagaacacgacgccgagcagcgcgaccgcgacgacggccagcaggttttcgccggcgccgggcgagctgccgctcagcaaggcactcgacgcaagcgcggccagcgcggcggagacgccgctcagcacatagctggccgcgacatacgcgttcacgcgcagtccggccgcgcgggcggcatcgcgatgcgcaccggtcgcggcgagccgcaggccgaagcgggttcggtgcagcagcacgccgaacagcagcgcgacgatcagcaacgcgggcgcgagatgcggtatgccgaacgggccgctgtcgatcagaaaggcgagcaccgggctcgccgccgcgaccgacgtgttctgcgtcagcaccagttcgaagccggcgcacagattcatcgtcgtcagcgtggccagcagcgggacgatgcgcagcgcgatcaccgcgaacgcattgagcgcaccgaccgccgcgccggtggccagcatcagcgcaagcgccgcgccgtcaggcgctccgtcgcgcagcgcgacggcctgcacggctgcgcagaggcccatgttcgccgcgaccgacaggtcgagaccgccgcgaatcggatcggggccgccgccgatcagcacggccgtcaacccgaacccgaggatgccgaccacggccgactgctgcagcacgttcgcgaggtttgcgacggtcagaaagagcggcgaactcgcggcaaacacggcacacacgacggcgaacgccagtgccgcgccccagcgcagccagaattgtgcgccgaacgtgcccggcagccgcgcgaacgccgctccgggcggcgcacgatcgaggatccggttcatgcggccacctcctgccgcggcgtgtggccgcgtgcgccggtcgcccacgcgagcagatcgtggcgcgtggcgtcgcgggtcgcgacgtcgcgcacgatccggccgcgtgccatcacgagcacgcgatcggtgacgtccagcagctcgatcaggtcgctcgagaacagcaggatcgccgcgccgtcgcgtgcgaggcgatcgagcagccggtagatttccgctttggcgccgatatcgacgcccaccgtcggctcgtcgaagagatacaccggcgacgtgcgatcggcgccgcggctcagccatttcgcgagcgcgactttctgctggttgccgccggacagctggcgcaccggcgcgtccgggccgggcgctcgcacgtcgagcgcggcgatcagccgttgcaccgcgtcgtcctcgcggcgccgcgcgaccagaccgaatcgggtgaagcgcgcaaggctcgcgagcgtgatgttctcgcgcacggacaggctcggcgcgatgccgtgcgagcggcggtcctccggcacgaacgcgatgccgcgacgcaccgcgtcgcgcgggctgcgcagccgcgtcacgcggccgtcgagcgtcaccgtgccgcgcacgccgcgttcgagaccgaacaggctgcgcacgacctgctttccgccggaaccgagcagccccgtgacaccgacgatctcgccgcgccggacctcgaacgacacgtcgtcgaaccggccgggcgccgcgaggccggcgacccgcagcgcggacgggccgggcacgcgcgccggcgcttgcgatcgcgcggcgatgccggtgccgatcatcgccgcgacgagcgcctcggtcggcgtggtccgtgcgtcgacgtgcgcgacgtcggtgccgtcgcgcagcacggtgacgcgatcgcagatcgccgcgatctcgttcaggtagtgcgacacgtagaggatcgtcagcccgcggcggcgcagccggtcgagtgtctgcagcaggcggtcgacctcgctgctgacgagcgcggcggtcggttcgtcgagcacgaggatgcgcgggtcgcgcatcagcgcgcgcgtgatctgcacgatctgccgctcggcgacgctcaactcggcaatcaggcggttcggcggcaggtcgaggccgaaatgcgcgtgcagcgcgtcgctggcatcgcgtcgcatccggcgtgccgccagcagcccgagcggccccgcgccataggccggttcgttgccgaactgcaacgcctcggcgaccgtgaacgtcgccggcagcagacgctcctgatgaatgaacgcaatgccctccggcggcgcgcggtgtgcgagcgcctgtgtcgcaccgtcgatcgcgatcgtaccggcatcggcggtgtcgatgccggcgagaatccggatcagcgtcgacttgccggcgccgttctgcccgatcagcccgtgcacggtgccgcgcgcgacgtcgagcgacgcgccgcgcagcgccggcacgccgtcgaagtgtttgacgatcccgcgcagcgccagcgcgggcgggcgcgagtcggtgctcatttcggggcggcggcctgcccgagcgtctgctgggccgagccggcgttgttcttcgtgacgagcagcgacgggacgtacgtatagggcggcagcgtgcgctcgccggccaggtagcgcgcgacgttgtcgactgcggtcttgccgatcagcgcgggttgttgcgcgaccacggccgccgcgctcgatttcggatctttcacgagcgcgacgacatcggggctgccgtccaccgcataggtcctgatctcgctgcggcgcgcggcgtcgacggcctgcgtcgcgccgacttgcggcacgtcccacgcggcccagatcgcggcgatctgccccttcgggtatttcgcgagcaactggctgacctgcgcgtacgcgctctgcacggtgttcggaatcacgtcacgcaactcgggctgcaggatcttcaccttcgggtagtacttgagcaccgccttcaactggtcgtagcggatcgcgcacaccggcacgccgtagaagccgttgaacacgagaatgttgccttcgccgtggatgtcgttgacgagcttcagcgcgagttgctcgccgatgaagaagttgtccgaggtcgtgacgttgaggctcgacggcgaggccgtgtcgatggtgaacagcggaatgccggcctgccggatcttttgcagccacggctcgagcacgctcgccgtgccgagctgctcgatgatcgcatcgggcttttgcgcgatcagcgtctggatctgcgcgatctggcggttgtcgttgcggccggcgtcgagtgcgatcggcgttccgccgagccgcttcacttcgtcgatcgcccctggtatgccttcaggtcccagtaatgatcggtgccgatcgccgtgatgccgatgcgcttgcctttcagcgacggtacggcggcgttacttgccgctgcatcgctttgcgcgcgggcaggggagagcgcggcgacggcggcgagcgtcagcagggcggcggcaaaggtgcgacgggttcgggcgggacgggtcatggcgtcgatgggcgctgaaaaaggagggagctgaactttgcgactctaatgacaacgctcccgcgcgctaaccatcgattcctgctacgcatatcacgcgcgtgctcgaatgcttgtgccaggcgcgacgcggtcggcttcaacgatttgccatccgaaggaatatcgattgccgaatcgctcggtttgaagcggttcgccgcactgatagattttccggataccgccaccagccaaggaagacccgcatgcgattcccgtttcgccgtccgttgcgccccgtccggatgatccgcgcgctcgcgctcctgtccgttgccgcgttgaccgtgcccgcctcgcatgccggcccgctcaaaggcgcacccgcgccgttcgacaagggcggagtgaaggtcgcgctcgtcaactacctgtcgaccggcgatttcttccaggcatacgaggccggcgcgcagaagcaggcgaaggcgctcggtatcgacctgcgcatctacgagggccgccaggacgcaaccgagcagcgcgagcagatccagcaggcgatcagcgtcggcgtgtcggcgatcatcgtcaaccacgggctcccgaatcgctgaaggacgtcgtgcagcgcgcgctggacaagggcatcaaggtcgtcgcgttcgatgtcgacctaggtaacccgaaggtgccgcagatcgagcagagcgatcgcgacctcgcgaacttgctgctcgaccaggcggtgaaggacaacggcgatgcgttctcggccggctacgtgtacgtcgccggattcgcgccgctcgaccggcgcgacgccgcgtggcgggacttcaagcgcgcgcatccgaaggtgcgcgagcaggcgcgctggggcaccgtcgacaatccgatcgcgcaatcggtcgcgaaccaggccgcggccgcctatcgcgcgcatcccgacatccgcgtggtgttcgcgccttacgacgaattcgcgcgcggtgcgaagctcgcggccgacgaggcgaagctggcgtcgaagttgcgcatctatagcgccgacatttcgaccgccgatatcgaggcgatccgcgcgcccggcagcgcatgggtcgcgacggccgcgacgaatcccgcggtcgtcggcgcggtgtcggtgcgggccgccgcgctgctcgtcgcggggcaagatccgggccggcggatcgtcgtcaagccgacgctgatcacgcgcgatgatctcgtgaagaacgacatccacacgatcgcggagctcggcgcgaagtttcccgcgttccgcgcaagcgacgcggtgacggcctcgtggattccggcgacggattaacgcgcggtggcttcttgcctacggtacgtgaccatacgtagcactgacgggctgcgattctcgtgtgcctttccgggcagacgtctgcaatccgacggatctcccgcatccgatgaacagcacggcaagttcagtgtcgacgatcagcgtgccaatgaacgcatctatcaaaacctggctcgcgtgatcgacccaatggcttgaacgactggctaaacccaacgatttgcgtaacgtgacagttgccgccaggaacggccgcttcccgtcgggatgcggccgtttgctggatgagccaatggccgcttgtggccggcaaacgatcgctcgccggccgttgggtcaggtctccgttagttccgccatctcaagcgcatcgtcaacctcgatgccgaggtatcgtccaggccgacggacgcgatccagcgatgaaccggccgagcgtattgccggcatcgaaagatgcggcgaagcgtgcagccgactcggaagcagtatcaattttcgctgtctgcttcgctcctctttcgttttgacggtcagggaaaggaactcgaaagagctttcgtgtagcggcaaaaacgcatcggcggttggcgaggtcaaggattccaacaccatcgcgaaccaaacccgccgtctgctcgacgcgatgtctcccaacagcggtcattgagaaaggacgatgatcgtctcttgtcggccgatcagggaaataggcaccaccatcgtcttcttccagcgaaacgagccggttccaatcgcatccattgggctacagtgaacatttcccgccaccgtcaaccccggcgcccatccaataccgccgacgaggccaactcatgcaacttcaaaccggcaacctgttcaccgccgatggccggcgcgatgaggacgaaaaatcgacctccttgtcacgggccagcgtctgaacgtcgagcgaatcgtatcgatgggccacacgagcccggacggttttggtatgacgacgcacgcgccgaatgggtcgtgctgttgtcgggggcggcggtgctcgaattcgaagaaggcccgacgcgccatgaaatgcatcccggcgactacgtgctgatcgagccgcattgccgccatcgcgtagcgtggacgcacgaagaaacgcaaaccgtctggcttgcgatctattacgaacgttgaatcaggaaatattgcgagggcggggccgaatacgatccggcgcgcagcatgccgccgcgcgccgaatgagacaaagcctcatcaacccggcgcggtcgttggataccgccggtatcgatgcccaaatagcaggacggcgcgcaaaaccgcgcgccggtacgcgtcgagaatcttattcctggatcaggaatcgattgcgattcttcgcgtccttgatccatgcgggtgcgcgaccgcggcccgaccaggttgccccggtcttcgggtcgcgatactttgcctgcacggggcggccgcttgcttggccggacggccgcgacggttaccgaaaatgtcctttcggtaatgccgaattccgcaaccttggtgcggatgtcgtcgacgatcgcctggaattccgcggcacgtgcagcttcggctttctcggccaaagcttccatttgggctttcagttccttgtacgttgccatgtatcgctcttcaggtttgagtactcacatgatagcggtttcaacggaaaattttgaggaaaattcgtcgactacgtgttttgtcgtcaatatggcgatgcaggactgcttcgaacacctgagaagtgtgtcgtattgacgaagacgtagaggattacccgggcatctttaacggcacgagcatgtcaagttgaccgatcgcacgggttttcttcttcaagacaaacaatcgggatttaactactctttacatttttatgaagtatcgggaattcactgatgaacagagacgagaagctgattcagattgccgccgaattcggcttcaatccggacgaggaaatcaggattggcggaaagtacaccccgttctggtcgacgggaatacggcctatattgccggccagattccacggatcggcgaagtggtgcatttcgttggcgtagtggggaatccatttcgctcgatgaaggtcgccgggctgccggtgtatcggcactccgtgcgctctcgctgatcagaaagcgctgcggcacgcttgacgtaatagcgacggtgccgcgcatgaccgtgtatgtgcgaagtgcacccggcttcacgatgcaaagcgaagttgccgacggcgcatccgatgtgttgtatgcggtgcttggcgacgccggtgttcatacgcggacatcggtcggcgtgctgcaattgcccaaaggcgcatcggtggaagcggatttcattttcgggttgaagcagggcaatgccggtatctgattccgacgggctgtatctcgcgggtagttcgtttcgcgaaacatccggatattcgcgcgcgacacgcgagtcactaccgacaagcgcttgcaatacccaaaaacacccgccgatggacttcgacaggttgcccgatcaaaggatttgacgaagcgtcgggcggcgttcgataccggcgatgtgaatgcgcgcggcgagccgggcaagtgggctgcgccgtcgcgcactccgtgtcgaaacaatctcgcacgatggcgcgttacgcaggcgcaaacgttgtcgtcgcgcacggcgtacgacggacgtcacacgttcccgtccgcaatcgtcgtgaacacgaaccccgggccacgctcatgcgcgctgcaaatcctcccgttgcctgcccggcggcagtgcgccggctgcacgccattcaagtagccggcccatcgagaattcatccccggccggccgccgcatgtgcgcccccgactccccacgatttccggaaattccccgccaatatcggacggcatccccactttgggagatgccattgcccgacagtaagcctacgattgaccacagggcatcggggacggatggcatcagaacaagcgggcaggcccgccattccgagtcgaaatcaacacatgcccacgcagtctactgacacagcttctgcttacgatcgcgttcgatgtgtgcggtgagtcgctttcatcgcagcgcgatggcgcgttgatgacggaaggcctgctgtcgtatttcgggaatttcaatcaatatgctggcacgagactatgtggaacgagagctctctcacatccagagaatggtggctctcctggacagcgaacagaacgctgacgatgtgtcgatgtcgggcgcggtgcgtgtgcggcatccgagctactggcgcgggcgaatcgaggagctgctgtcggcgcccgatgtgccgcgccacatcagaaagctcagcgaagcggtgctcgcgaagatcgacgagatggaaatgcgtttcgcggcgatgaagtaagtacatcgtcggatgcggcgccggcatgtgtttcgtcgcgtcgtcgaccggatggccggtcgcttatccggccgccatcacgtcaagcagggccgcacggaatgcggccatctccgcagcggtgccgatggacacgcgcagatacgccggcgggcccgattcgcgaatcaggacgccgtggcgcagcaggccgctccagatccggtgccgatcggcaaactcgccgaacatcacgaagttcgcatcggaatcggccaccgtgaggcccaggccgcgcagccagccgacggtcgaatcgcgttcggccttgatcgtctcgacttgcgacagcatctcgtcgcgcgcgaccagcgccgcgcaggccgccgcctgggtgaaggcggacaggtggtagggcaatcgaaccagcttcagcgcctgcacgatcgcgggcgcgcacgcgcaatacccgacgcggccgcccgcgaacttgaatgccttgctcaacgtgcgggtcacgatgagccgcggatgatccggtagcagcgtcaccgcgctgggtacgccgcgacgccggaactccgcataggcttcgtcgacgacgaccacgcccggcgcgacgtcgaggatggcgcgaatatcgccgaccggcagcgcggttccggtcgggttgttcggcgacgtcagcagcaccacgcccggctggtgcgcgcggataccgtcgagcgcctgatccacgtccagcgcgaaatcccggtgcgcggcaacgtatggaggcgcgtgaaagtcgtgcggcagtattcgtcatacatgggatatgcgggcgtaaaggccagcgccgatcgccccgggccgccgaatgcctgcaggatctgctggatcacctcattcgagccgttggcggcccagatgcccgctgcgtcgaccgtcacgccggtgtcgtgcgtcagatacgccgccagatgcgatcgcagcccggcaaagtcgcgatcgggatagcggttcgccgcgcgcgcggcgtcggccaccgcggtcgcgatgcgctcgacgagcgcgggcgacggcggatagggattctcgttgacgttcaggcagaccggcacgtcgagctgcggcgccccgtacgcgtgctgcaacctgaggtcctcgcgcagcggcaaatccgacaaggcgatttctttccagggctgttgcattgaaaacactccgtacggtatcgattgatcggcgcagcaggttttaaggcggcaaaaaacaaaaaggcgccgcaggcgccttggttgtcgtcttgatcgggcattcacccgatgcaattgctagatgcgaaacgaaccacggcgcaacagggggcgtccgtggtgatggtgcagcgagagcgtggtgattcgaatcgtcatgcgccgcatcatggcataccgcagtccggaagaaaagcgcgccaccctgagtgcgccggattcgattgagccgaaacgccggcaaaacgcccattacgtctgacgataaacggtaacaaacgtcgtatttcgaccaaatgcgaacgagtgattcaaacgttggcgtcaattgactaagatgcgcagaagacgttcgacaaaaacgcacggcgcggggtagccagatgcaaatgaacgggttgattccatcggcatggatcgatgacgtctatgccgcggcactgggcgatcaacgctgggaaacggtgctggacgggctgcgatcgtgggtcggcgtgcgcatggtcacgctgctgtcgttcgacgacgcggcgcgggtgccggcgatcgagaaggcggcgggtgacgacgcgtcatgggtcgccgcgtgttatcacacgtacaacaccgagttctatcggtacgacccggtcgtgccggtcgccggcaactggccggcgggccgctggttcgaggacgtcaagcacctgtccgcgcaccagcgcgcgcacagcgagttctatcaggagttccttcacccttttgggatcggcagcatctcgggcctgtacatccatcgcagcgagggttcgggcgcattcctcagcgtccagggcggcctcgaatcgcaggggctgtccgacgatcagcgccgcgcgatcgaaaacatgggaatgcacatcagccgcgcgctgcagatccaggcgcggatcggcgagctcgaggcgcgtgtggccgcggccgaatcggcgctcgatgcgattccggtgccggtgttcctgctcggcgcgcagcgcgaattgcgctatacgaatcgcgcggccgatcagctgatcgcgtcggagccggcgttgcgggtggtgaacgggcgtttcgcgccggaaggctgcgtcgacgatatgcattggcggcacgcgtacgcgcgcggcgggctgttgttgcggcgcgcgacgggcgaaccgctgccgctggccttgatgccggtgcccgagcagtcgcgcctgatgcgcgagcggccgggcgtcgcgacgctgatgacggccgccgacctgcgttcgccgtcggcccgcgcgcagcggctgcgcgtgttctacgggctgtcgtcggccgaggccgatctcgccgtgctgctgtgctgcgacgggctgtcgccgcaggaatgcgcggggctgcgcggcgtgtcgatcggcacgatccgcacgcagatcaagtcgatctacgcaaagacggccgtggcgcgcgcggcgcaactgacgtcgctggtcatgcagacatgacggcaacggcaggcgagcgcgcctgtcgttgcacgctttccctcgttctttccttcctgaatcgcgccgccggcggcgcgcgcatgacattgcgccgatgtacacgcgtcgagatcagtcatcctacgacaatcgaaagcgaagcgatcgatcgatttccctgtcgaccgaggcaatcaaccagccgctcggcgcaaatgcgaacccgcttccggaaaacgtttcgcatagtgtcgcctaaacagagaatacgattcccgaaattcgctgcaaacccatcgtggctgcggttctacgggtatgcaccaagtgagttaaacgattaaccgacgtacattcgcgtcaacacgtcatacgacgtatgactctgcggtcggcgagcacggcgtcgaagcgtgcgcatgccggccgatcgccgcgcgacaacgagtacaaccatcaaggagactgacgatgaagcaccgattcacccgctcccgtaccgccctggccgttgcgctgctggccggcttcgcgatgtccgcccaggcgcgcgtgttccgctcggcggacgtgcatggcgacaacttcccgaccaacatggccgtgaagttcatgggcgacgaactgtcgaagcagacgggcggcaaggattcgatcaaggtgttcggcaacagcgcgctcggctcggagaaggacacggtcgaccaggtgcggatcggcgcgatcgacatggcgcgcgtgaacggtgcgtcgttcaacgagatcgtgccggaatcgctgatcccgtcgttcccgttcctgttccgcgacgtcgatcatttccgcaaggcgatgtacggcccggccggccagaagatcctggacgcgttcaccgcgaaggggatgatcgcgctgacgttctacgagagcggcgcgcgctcgatctacgcgaagcgcccggtgcgctcgccggccgacatgaaggggctgaaggtgcgtgtgcaaccgtccgacctgatggtcgacgagatcaaggcgatgggcggcacgccgacgccgatgccgttcgccgaggtgtacacggggctgaagacgggcctcgtcgacgcggccgaaaacaacatgccgtcgtacgaggaaaccaagcactacgaagtggcgcccgactactcggagacgcagcacgcgatgacgccggaagtgctggtgttctcgaagaaggtctgggacacgctgtcgccgcaggagcaggcggcgatcaggaaggccgcggccgattcggtgccgtactaccagaagctgtggaccgcgcgcgaggcgtccgcgcagcagacggtgacgaagggcggcgcgaaggtcctgccggccgcgcagatcgatcgcgcggcgttcgtgaaggcgatgcagccgctgtggacgaagtacgagaagacgccgcagatgaagcagatcgtcgacgagatcgaggccaccaagtgacgcgtcgcacttccctgaacggcgccgcggccgccggcggggcggccgccccggacggcgcggggccggcgcggccgcatgtcgcgccgctcctgcgctgcgtgaacgacgtgctgttccgcgtgctggccgtgatcgcgtcggcgtgcctggcggtgctgacggtgctggtgttctacgcggtcgtgatgcgctacgtgttcgagaacgcgccggatttcgtggagccgatcgcgctgctgctcgtgatcgtgatcgcgatgttcggcgcggcgatgaaggtgcgcgacggtggtcacatcggcctcgattcgctcgtgcgccggctgccgcccaggtcgcgcacggtggtgatcgcgatccagcacgtgagcctgatcgcattcgcgatcatgatcatggccggctgcggcagcatggccgccgagacgatgggcgaccgcattccgatcatcgggctgcccgaaggcgtgcgctacctgatcgcgatgccggcggcgatcgccatcaccctcttctcgctcgagcacctgctcgcgcttcgtcgttcttcgccggggcaataacgccatggaactcgcgatcctgtccgtcagttttctgattttcctcgtgctcggcgtgcccgtgtcgttcgcgctcggcatcgcctgcgtgctgacctatatggtcgaaggcctgccgatcgcgaccgcgatgcaggcgatgatctcggggatgaatgcgttctcgttcctcgcggtgccgttcttcatcttctccggcgaactgatgctgcacggcggcatcgcggaccggatcctgcgcttcgcgcaggcgaccgtcggccacttccgcggcggcctcgggatggcgaacgtcgtcgcctgcacgctgttcggcggcgtgtcgggctcgccgaccgccgatacctcggcgatgggcggcgtggtgattccgctgatgaagcgcgaaggctacagcgccgcgtacgcggtcaacgtgacgacgcatgcgtcactcgccggcgcgctgatgccgacgtcgaccaacatgatcatctacgcgttcgccgcacagggcatcaccgggatgctgcacggccagccggtgagcggcgtgtcgatcggcgacctgctgttttccgggctgctgccggtgttgtgggtgatgggcttcgtgctcgccgccgcgtactggcaggcggtgcgccacggctacccgcgccgcgaagacggttcgtccgcgctgcccgcgtttcccggctggtatgcggtgctgcgcagcttcgtcggcgcggtgcccgggctgatggtgatcgcgatcatcctcgtgtgtgtcgcgaaggggatcgcgaccgcgaccgaagccgccgcgatcgccgtcgtgtactcgctcgtgctgaccgcggtcgtgtaccgcacgctgacggccgagaagctgcgccgcgcgctgtcgcacgcggcgcgcacgacggggtcgtgctgctgctgatcgcggtgtccaacatgctgcgcttccagatgtcgtacctggagattccggatgcgatcgaggggctgctgaagcagtcgaccgccgcgccgtggctgatgctgctgtacatcaacatcatccaggtgttcctcggcacgttcgtcgacatggccgcgcacatcctgatcacgacgccgctgttcctgccgatcgcgatggcgtgcggtgtcgggccggtgcagttcgggatcatgctgctgctgaactgctcgctcggcctcgtgcatccgccgatcggctcggtgcagttcgtcggctgcgcgatcggcaacgtgtcgatcggggagacgacgaagatggcgtggccgtattacctcgcgatcttcagtgcgatcaacatcgtcacttacatgccgttcttctcgacctggctgcccagcctgatcagcggacacgcggtgttctgaccgtatgcgttgcctgacgcggcgccggacgaccgagggtgtccggcgccgcgttcgtttgcgcggtgccctttgaattcaccggaatgcgcccgcccgctcaatcctgccgcgcctccggttctccgtttccatcggccgaccgttcgtcgcgccgatccgcaagctcgcgccacagcgccgggcgcgcatgatcgcggggcggcagcgggatcacgtaggccaccctcgcacgttgatcacggccccgagtcgggcagcgtggccggaatgccggagagcggcgggtcggtatccggttcggaagccgtacccgggccgggcgggtgtcgaagcatcatgcgatttctccctggcgccgcgaaacggcgcatcaatagcggacccgcccgatcaaccccaacggatcgacggcgtgctggatggcggcggcgagttcccgttgcgcggccggcacgtgcttgcggtaatacgcgacgttgaccggcccgacgccatgctccgcgctgaagcagccgccggcccgcacgacgcgctcgtacagcgcgccgcgcagcgccacctgctgcagcggcccgtagcgctccgcgtcggcgtggggatcgacacgacgagatggcagccgccgtcgccgaaatgaccgaacgcgtgacagcgcagcgacggatgcgccgccgcgatccattgctcggcatcggcgacgaatgcggccagcgcgccgcgcggaaacgacacgtcgaacgacagcggaatgccgtgctgcgcaaccgcgaccggcagtgcatcgcggatccgccagaaccgttcggccggcgcacaggccgcgtcgagcaccacgcgttcgcctgccagcgtgtcgagcgtcgcaatcgtgcgttcctcgagcagcccgtcgagccccggcatgccggtcgcgatctcgacgagcgcgtagcatgcggcggcgtcggcttcaaacggaatgcgcagcgccggaaacgcggcggcgacgcagccgacggccgcggccgacatgaactcgaacgccgacagcatctcgccgaacgcgcgctcgaacgcgagcaggccggcgagcgccgcgtcgtacgacgcaaacgcgacgaacgcggcacacgacgaccgttcgagcggcgcgagcgcgaacgacacggccgtcacgagcccgtgggcgccgttcgcgccgatgaagcattgcgtgacgtcgaaacccgcgttgcgcttgcgcagcggcgcgagcgcgtcgatcacggtgcccgccgcgtcggcgagcacgacttcgacgccgagcacgttgcggcgcacgtcgccgtacttgatcaggcggctgccgcccgcgttggcgccgacgaggccgccggccgccggatcgctgccgaggtcgatcggcaggcagaggccggcgtcggccgccacgcggttgatgtcggacagccgcacgcccgcctcgaccgtgatgctgcgatttgccgcgtcgaacgcgcgaacggcgcgcatccggtcgaacgagaccacgcattgcgtgccgctgcgatcgggcacggcggcgccgacgagcccggtgcgcgcccctgcgcgacgagcgcgacgcggtgcgcgacagcgacccgcgcgagcgcgctcgtgtcggcggtcgaccccggccgcgcgacaccgagcgcgatgccgctgtgcagcgtcacgtccgtcgcgtacggctcgcacgattcggccgacgcaccgtcgagccagccgtcgccgagcgtcgcggcgagcgcgtgccgttgcgcggcgcggtcgggcagcgcgctcatcgtcagccggcccgcacgagctgcttgcgcaggcggccgcgcacgacgaccagcgcgatcagcggcacgacgccgccccacagcgggctgtggcgcatcgcgatcgacaccgcgagcgcgacgacggtgacggcgagcagcacgatcgacagcgaacgggcgcgcgcatggtcgacgaaggtgccgtcgacgaacccgccgtccgaccacgcggtatgcacgatgccgacgaccagcacgcagacgagcatcgcggccggtccgagttcttctccccacaaacggctacctgtcggcgacacgagcgccagcaccgcgccgatcacgaggaacaggtcgacgccgatcgcgatgctgttgcggtccgcgcggcggatcagccatgcgccgtgcacgagcgcgagcacgccgccgatcaggaacgcgtgcgtccaacgcacgtccggctgtccgggcccgagccggccgtagaacaggaacacgatcgccggcaggaagttgctcgcgtgcagcaggtagtcggtgatgggattgctcgatttcatcggggattctccttcgtcgaaacaatgggcgacgcgtcatgcgtcgtgccagcggaacagccgcgcggcggcgaacaggaacagcgccgtgctcgcggtcatgccgagcagttgcggcgcgagctgcgcgtacggggcgccgtcgaccagcgcgccgcgcagcgcgacggcgaactggttggtcggcaggaacgcgagtaccgccttgagccaggccggtgcgtcgtgcatcgggatcgtcaggtcgctgaagaacagcagcgggtagtaggtgacgttgcacgcgagttcggcggccgcgagcgaccgcgtgcggctcgcgagcagcacgccgatgctgagcaccatcgccgcgccgagcagcacgatcggcaacgcgcgcagcccgtccggcgtcgcgatcggcagcgcgatgccgaacgcgacgcgtgcgaccgtcagcagcacgagcgccgacagcgccatcatcgccatccgcgcgacgatcagcgcggcgaggaacacgccgcgcgagaccgggaagcacacgtacagcttgaaggtattgcgttcgcgcagcgacgcgatcgcggtggtcgtcgagttcaggccgatcgccatgaacgccatcacgagaatgccggtcgcgaagaacgcgccatagtcgaacggacggcgcgccggtgccgcgttctcgaagcgcgcctgcgcggccggcagcccgagccgctgcgcggcgcagcgggcgagcgcgatctcgacgacgcgcgacgcggccttgaccgcgagcgagccgttgaagtcgtagcggatcgtcgccggcgtgcgctcgtcggcgccgagcacgacggtcacgcgatcggccgccgcgccgcgcccgccgaaggtcgccttcaccgtgtcgctgtgcgtgaggctggcgacgatctgcgcttcgcatgcgcggctgtacggcgtcgcgccgccgggcacgtcgaacgcgatgtcggcggtgccgagcgaccccgatccgccgaacgcgaacagcatcacgctcagcaggaacaccgggaacacgagcgtccagaacagcgacgagcggctgcgcagataaccgagcagctcgttgcgcacgagaatcaggaacaccttagtcatggacggggccctcggtacagaggcgcagcaggtcgcccggcgtgctcggcgcgagcgcgagatgctggatgccctgttcgccgacgatgcggtgcacgttcggatgaagcgtcgcatcgccgaacacctcgacgacgtgcgcggccgacacgcgcacgccggtcacgcccggcagcgctgcgagccgcttgcgcagcgcgcgcgcgtcggcttcgtcgcggcaatgcaggaccgcgcgcgcttcgccgacgagctcggcgcgcagcgcgtccttgtcgccctggtagcgcacgccgccgtcgcgcacccagacgagatcgtcgacgacggcaagctcttcctcggcgtggcagatcatcgcgacgctcgtgccgcgcgcgcggtggcgcagcaggtcgatcacgacgcccgcataacgacggtcgaggccggtgaacggttcgtcgagcacggccagttcggggcggtgcgcgagcgccacgtagagatccatgcgctggcgctgccccttcgacagcgcgcggcacggcttgtcgagcaattcggcgatgccgagcgcctccgtgaccgcggcgtccgcgtgcacgtacatcgcgcggtgcagcgcgacgatctccgacacgcggagatggtcgggatactcgaccttctgcagctgcgcgccgagccgccgcagcgacggcgtgtcgcgcatgaagcgcgcggccggcacgtcgagcacgcgcacgtcggtgccgccgcgccggaagccgagcagcgtttcgagcagcgtggtcttgccggaaccgttcggcccgacgatcgccgtgaccgcgccgagccggaaccgcacgtggcgcgcggagaaacggaaatcgccggccgcgacgtcgatcgcgcgcgcgccgagcgccgcacccggcgcgtgcgcatcgggcggcggctgcgaggccgtgcgcagcggccggtcgaacgcggtgtgcgggccgaacagcgcgcgcacggaggcgaggaacgaatcgctcatcgtcggcttcctgtcagtcgaacagcatgacctgcgtgtcgcgcgcgccccggtacgggttgcggccgtgcgcgaccagcatgttgtcgacgacgagcacgtcgccggcctgccacgggaatgcgagctcctcttcgtcgaacgcatcgtagatcgcgacgagatcgtcgaacggcatcggcgagccgtcgccgtagcggatctcgtacgggaacgcggcgcgcgcgccgtacatgcgctgcaggtagcggtagctgagctcgcccatcgagcgcggattcgggtgctgcgcgctcgcctggttgaaccagacggtttcgccggtgcgcggatgcgcgcgcagcgcgctgccgacgtgcgacacggtcacgctgccgtcgtcgagccagcggcaaccgacgccgcgttccgcgcacagccgctcgacctcgtcgcggtcgcgcgtgccgaacgcgtcgtgccacggccgatggtattcggcgaacggcaggttcgggttggcggcgaggccgtccgcgcgatcgccgggcgccgcgaagttgcgcaggtacatcacgccgcgcgcggcgaaccgttccgcagcgcggccggcacgcgcgccgtcacgcgccgcatgtcgcagatcggcgtttcgccgcccgcatcggccggccgccggcaatagaacgcgacgaggcgcgggaacgtgggcatataggccatctcctggtgcagcccgatcttgaacggcggcggcatgcgggtcgattcgtacacctggccgtcgatctgcttgcgcggcgcggcgcccgccgtgtaaccgttcgcgtgcgccggatacagcgcgccgaggcggccgaacgcggcggtgtcgggcaccgcgaaaccgcgccacagcagcgcgccgcacgcgtcgagcagcgtgtcgatcgtgtcgagccgcgagcggtaccacgcgacgaacatctccggcgaggtcgcgagctcggcgctgcgcggcgtcacgcacagcggcagcgtcgcgccgggcgcgaccgccgcgcagtgcacgtcgtcggcgccgagccgcacggcggcgtgcgcggcgagaaaggcgaggtcggtcatcgctcaggccagcgccggtttcttcagcaggatctcgaagccgagcgcgccgagcccggcgctcgggctgtagatcgacgcgacgtccgcgaggccggcttcggcgacgagcgcatgcgcttcgtcgagcgtgatcttttcctcgacgtgggtcggcggatagtcggcggcggcgcgcatctcggtgaagcggtcgagcaggtgctgcggcgcgtcgcggcgcatgtcgtgcacgagcgcgatgccgcccggctccagcacgcgatacatctccgtgaggctgagcgccttgtcgggcaggtggtgcagcgtcgcgcggccgacggccatcgtcagcgtgccgtcgtcgaacggcagcgcgagcgcgtcgccgacgcgcatctcgatcgtgtcgtcgagatcgagttcgcggatgcgcgggcgaccttcgtcgagcatcgccggatcgaggtcgatgccgacgtagcgccagccgcgcatcgccgggtcggtggcgagccgcaccggcacgacgccggtggccgtgccgatgtcggcgatcacgccgggcgtcatccgcgcgcgagctggcggatgcggctgatgaacagcaggtcccacggttcgagcgtttcggtggcgaagcgatcgtagtcgttcgccgggcgcaggttcttgagcagcatgacgttccttttgctgaagggtgccgatggatgaaggttcacagccagccgaccggcacggcggccagcagccgtcgcgcggtcgcgctgttgacgccgaaagccgggcggcgccggcgctcgaccgcatgcgcggccatcgccgcgatgcgcgcgccgagcccgacaccgacgccccacgacggcgcggcgacaccgagttcgagcagcgtcgcggccgtcaggaaatcgatgttcggccgcaacgcgcggcgggcgtcggcctgggcgcagcacgcgtcgaacagcgtcacgtacgcgccgtcgaagccgtgtgcggcgaacaggccgcgcatgtgcggcggccgcggatcggcgacgaacagcggatggccgaagccgtacagcgtgtgcttcgcgtcgagcgccgcatcgatcgccgcgcggccggcggcgtcgagcgcggcgggcggtgcgtcgatgccgccggggaccgagcgtgcgagcgcggcgagccagtgcatcgcttcgagtgccgcgccgacgtgcgacgggccgctcgcgaggaaaccggacgcgatcgcctgcgtgagcgtgacgccggtgccgatcgcgacgcgcggcgcgagcacggtcggcgtgatgtagccgaagccggcgtgccacgcgacgagcagcatgtccattgcggtttgagcctgcacatcttggcgcgtcgcgccggtcagcacgagcatgcgttgcgcttgcgtcgcggcggtatcgagcgaagcgccgccgtcggtgccggcggcaaacggacggccttcgatcgccgcgtgcagcaggaacggcgcggccgccgcgcacagcagcatcgtgtcgaggtcggcgtcgtccggcgcgttgccgtgcatgcgtgccgtcacgtcgtcgaagccgcgcaacaggccggacgcggccgcgaacaccggcgcgacacccgccgcgccgagatccgcggcgacggactgcgcggccgagccgggcgccagcgcctcggcgaacgccgcgagccgcgtgcggatcgccgcctcgtgcttgccatgagccgcgttgtccggcgcgacgtcgaaccacaggtgcgcgagcgcgccttcgaacgtcgtcgcgccgatcagcgcgttcaggtcgagatcgcgcacgcgcagcgcttcgggctcgagcgtcgcgccgtcgatgtcggtgccgcgatggcgcgttgccgggcggccgagcaggttgcgcggcgcgccgccggtcgaggcggccgaagcgttcgtgccggaatcgagtgtcgtgtccatgtcattccgcctgcgcgagttcttcgctgctgacgctgatcgccgcgtgcgccatcgcggcgatcacggccgcgtgctggtcgaccacgggcagcacgttcgcgaagtagtagcgcgcgcttttcagcttgccgcgatagaacgcgagttcggccggcgtgtcggccgtatccggcgcgtcgagccggcgcgcggcgatcgtcgccgattcgagcagcacccacgccgacgtgacgacgccgaacatctcgagaaaacgcgtatagaactggctgctgcggtgcgtgtggccgtcctgcacgtcgcgcgcgatgtcgtcgagcgcggcggcgatccggtcggcgcccgtgcgcagcgcgtcgaacagcgggcgcagctccgcatgcgtgcccgtgtgatgctggcgcgcgaggaacacgtcgagttcgtcgcggtaatactggatcagccgcgaatggcggccgaagccgagcttgtcgcgcacgaggtcctgcgcctggatgtagttcgtgccttcccagatcgacaggatcttcacgtcgcgcgcgttctgctcgacggggctcgcgtcggtgtagccgagcccgccgtgcacctggatcgcggtttcgcagatccgccacgcctggtcggagatgaatgccttgcagaccggcgtcagcagcagttgcagcttgcggtggcgctcgatctcggccggatcggcgtcgggtgtcgcttcgagcatcgccgcgcgcgtggcggtcgcggcgagcttgccgagcaggccgcggcagccgtcgacgcggctcttcatgtcgaccagcatgcgctgcacgtccgcgtgctcgacgatcgcgacgcgcgcggcattcgtgttcgacgcgcgctcgatcggccggccctgcagccggcggcccgcatactcgaccgcgtgcaggtacgcgctcgacgcgacgccgacgccgaacatcccggtactcatccgcgcctggttcatcagcggcatcagctggagcaggccgacgttgcgccggccgccgagcagccagccgcgggtcgtgccgttcgcgccgaacaccaggtgcgtgttcgcgcagcccttgagccccatcttgcgcggcaggccgatgcagtcgatatggttcggctgcaattcgccggtttcctcgtccggccagaagcgcggcacgacgaggcacgacagcgagaatgagtccggcgacgccgtgtcgatgcggccgagcacgaaatacagcgtgttctcggtcagctcgtgcatgccggccgagatgtaaaccttctcgccgtcgatcgcgtagatgtcgcgttcgagcggcgtcgcgcgcagcgcgaccgcggtgaggtcggtgccggcctgcggctcggtcgcgcagaagcacgcatcccagcggtacgcctcgagcggcgcgatcagcgccttctggtgcggcgtgccgtgcatctgcagcagcttgaccgcggggcgcgtgaagccgccgtacgtcatgaacgacgggttcgcgcccatgaacatctcgtagatcatctgcgtgacgatcggcggcagcccgtgcgcggtgccgaacagcgtgttcgaccattcgtcgcgaaaccgcgcccacaacgcgtggaaatgcgacggaatgcgcacctggccgtcgtcgagcagcgtgcagccctcgacgtccgcctgctggtagctgcggccgaggtcgagcgcaaagtcgcgcgcgcgttcgagcagcgcgtcgatcgacgcacggtcgtgggtgccgtacaggccgtgttccgccaggaactgcttgtcggcttcgaacagttcccacagaaagaagcgcagttcgcgcaggctgaccttgtaggcgctcatcatgcgtctccttcgatatcgagtgcggcatcgaggccgccggcgaggtcgacgacggccgccgccgccgcgccatgcagtgccgcatcccacacgagcaccgtgcggcgctcgccttcgtcgagcgcaccggcgagccggatcagcgcggccgccgattcggccgacgacaggtggcccgatccgtcgtgctgaatccgcgcgccgaccgggatcgacgcggcgtcggccacgcgcgccgcgaagccgggatcgaagccgggaggcacgcaccagtcgatctggtcggcgcgcagcccggccatgtcgagcgcgcggcggatcgcgcgcgcggcgagcggcgcgagcgtgtcgcgcagcgcgcccggcgcgtcggcccacggatcggcgatcgacggcccgaactcgagcgcgacggaccgcacgccgccccagtcggccggctcgggcgccgggcccgcgcgcgacacgagcagcgcggcggccgcgtcgccgtagccgaccaggtcgccgaactggcggaagaacggatagagccacttgtcgctgaggatcacgagcgcctggtcgccttcgtcgagcagcccgtcgagcagcatcagcgccgaataccagccgagcgtgccgttctggccgagcgcgaacggcgtcacgcgctgcaggccgagttcgtactgcatgcggccgacgaccgagtcgccgatgccttcgttgagcgcgcagctcgcgacgatcacgtgggtcgtgcgggccagttgcccggagccgagctggtcgcgcaggtcgagcgcggcgtcggcggcgagatcggcgaggctgcgcccgggcggcgcgacccgcagcgcgggccggccgcccggcgcgaggcgcgtgccttcctcgggcgtcagcgcacccatcccgcgcggccgcgcgaagcgcgcctgcggcagcagcaggtgccggtaaccgggatggcgctcctgcgcctggatcgcgctgaacacgacggcgggcggcagcaccacgacgccgccggacagggcgagcgtgccgggctcggcgacgcggcgcgcgccgaggcaggtttcatcgagcgtcgacagggtcatgcggcggtctcctcgttcgtgtgcgcgaacgcgtcgcgatactggtttttcagcgcggggcggtcgatcttgccgttcgggttgcgcggcagcgccggcagcggctcgacgacgagcgggctcatgtaggtcggcaacgcgtcgcggcacgcgcgtgcgatgtcggcgcggcacgcgtcggcgtcgagcgtcgacacgacgcacgcggcgatcgcctcgccgagcgacgcgtgcggcacgccgaacaccgccgcctcgcggatgtggggcagcgcgaacagcacgtcctcgacttcggtcgggctgacgcggtagccggaggtcttgatcatgtcgtcgccgcgcgcgacgaaatacaggtagccgtcggcgtcgcgccgcacgatgtcgccggaccacaccgcgacgtcggggcgcgggatctcgccgtgccggcgcggcagcgggcgaaagcgctgcgcggtcagctcgggccggttccagtagccgagcgtgacgaacgcgccgcgatgcacgagttcgcccggctcgtcggccgcgcattcgctgccgtccgcacgcagcacgaggatctcggcgttcggcacggccttgccgatcgacgtcgggcgcaacgctgcgtcggccggcggcaggtacgtcgaacggaacgcttcggtcagtccgtacatcaggtacggcgcggcgtgcgtgaacagcgcctgcaggcggtgcagcagcggcgtcgcgagatggccgccggtgttcgcgaagcggcggattcgcgtgcgcgccgtatcgctccagcctgccgatgcgagctgcatccacagcggcggcacgccggtgatcgacgtcacgccggacgcgtcgcaatggcgcggcacgtcggccggctgcaggaagtcgagcggcgcgtaacacgcgcccgacgccagcgcggtcgtgagctggctcaggcccgcgtcgaagctgagcggcagcacgccgagcacgacgtcgtcgtcggccagcccctggtacgcggcgacgctgaacgcgcccgacaccaggttgcgatgcgacacgaccacgcctttgggcttgccggtcgagccggacgtgtagagcagcgcggcgggatcgtcgtccaccgggcggccggcagcgaacggtgcagcagcgccggcgtcggacgcggcgatcgcatcggccagctcttcgatcagcatcgtgcgggtgccggcgagcgcggcgagcgccggcaggcgcttcaatcgctgcgcgccggtcatgaacagcgccgcgccgctgtcggcgacgatgtgttcgatctgcgcttccttcaattgcggattgaccggcacgaagatcgcgccgagtgcgttcgccgcgagcatcgcgaccacggtttcgatgcgtttcggcgcgtagatggcgacgcgctcgccgggccgcacgccgcgcgacgcgagtgcggcggcgcgcggcggaccgcgcgcgcgagctgttcgtaggtcatcgtgccgccgccgtcggcatacgcgggatgatgcggccagcgcgcggcgccgtggtcgagcaggtcggcgatgctgatcagggcgttcatgatcggctcctctctctggtgggtctaggcgggccgcacgtacacgtgcgcggcttcgtgggacaggaaatgcgccatcgagtacgtccggtgataggcgccgcagcgcgcgaatacggcgatgtcgccgacctgcggcggagcgccggtatcgtcgcggccgatcacgtctgcgcggctgcacgtgctgccggcatagatcgtcggcacgccgcgcgcgggcggtgccggcgtgcggcgcacgagcgacggcgcggccagccggcgcatcaccgattcggtctgcgcgagcaggaacgcatgcgacagcccgccgtcgcagacggcgatcgtgcggtcctgccatgtcttgaccgcgacgacgcgcgtcgcgaacacgcccgcgtcggcgaagatcgcgcggccggattcgtgcgcgagcgagtactggccggccagcggggcgagcgcggtcgcatagcgctcgaacgcggcatcgcccgggtgatcgtcggcgaagccgccgccgaggctcagcgagccgagcggtgcgccgttggccggcgcgagatcgcgggcgagcgccgcgagccgctcgggcagcacgagcgtgtcgggctgcgtcgcgtcctggcggatgaacgaatgcgggccggagaacacgtgcagcccggcgacgggcaggccggcggcggcgagcgtgcgcaccgcgtcgtgcgcctcgttcggcgtcatcccgaagtggtcgtgccacagcgcccgcgcgtcgtcgccggccagcgcgccggcattcacgcgcagcagtaccgggcccggcgtgctgccgccggccgcggcttcgcgcgccagcggcacgaagcgcgcgaccgcatccgggttgtcgagcacgaaatggcagcgcgacgcgagcccggcgcgcatgaacatctcgtccatcgacgggttgttcaggtagcgcggcgtcctgatccggccgatcaccgcgtcgagttcgccgcggctcgcgagttcgacgccgtcctcgtacgcatgggcacagcgcgcgagcatgtcctggttcgggttcgccttcagcgacacgatcagccgcgtgccgagccgcgccttcagcgaccggtagcgcgcgatcgcgacttccggctcgtacacgtagcacggcgtgcgcaggtcggcgatccacgcgtggtcgccggcgggtggaagcgggtgctcaggcgtcatggcggcccaccggatgaagcgtggcggcggcatacgcgccgcagttcgattgcatcacgccgagcacgcgctgcccgcgcgcgactgcgtcgagcccgacgtcggccaggttgatcgggaaatccgagcagcacgcatggccgcgcgcatggatgttctccgcatacagccgctcggccggcacgcgcatcgcgcggcacagcgcgttccagcccggcaggtcggcgttgtgcggcagcacgagctcgtatgcgtcgagcgcgtgcggttcgagcgcgaccgccgcgtcgatcgccttgcgcgtgtacggccactccatcatgatcaggtcggcctcgttcgcggcgacggtgtccgagccgcgatgccatttcgcgtgcgtctcgatcgcgatgccgccgagccggttcttcgtgctgttgcgcgcgatcagcatcgcggccgcgccgtcgcactgcacgcccgtcatctgccgcatccggtaatcctcgccgtacacgcggtcggacgacacgacgagcgccgcgtcgagttgcggataacgacgcatcagcgcgcgaacggtttcgatgccggccgcgaccgacacgcagttcagctgcgcgaccgagccgagccacagcggctcgatgccgagctgcgcggcgagctcgtgcggcaggctgcgcggcgcgggcggcacgctgaactgctgggtgtgcacgtggacgatcgcgccgatgtcggacggatgcacgcgcgcggtgtcgagcaggcggcccgccgccgcgatcgcgagatcggtctcgctcgtgtcgagcgccatgtggaagtagcggctgcccgactgcgcgatcgccgcggcccgttgcgccgggtagtcgcgctcggcggcccacgcctcgatgtcgacgggcaggcccggcagttcgtaggccaccgcgtcgatgccgatccagaaatcgcgtgacgcttgggaggagttcgtcatggttcagttgagcggcattgccgcgtagtcgagaacatcgagtttttcgaaggtcgcctgcacggtcggcgtgagcaggcccatctcgcggatcgtcggcaccaggcgccggaagatcgagcggcggatcgagctggagaccggcgactcgcgcaccatcgcgctgcattcgcgcttcgacaggcccatcggctcccagatgtcgtccgcgcacaggtgctcgtacagcacggccgcgccttcgcagacgaattcctcgcgctcgcgcagctcggtcgagctcatctccgcatacacgcggcacagcgtgatccggccgaccgcgaagtgacgcgcctcgtcgcgctggatccgcaggaagagatccttgatgaacggatcggtgctgtacgcgacgacgctctggaagatcgacagcgcgatgccctcgacgagcacctgcatcccgaggttcgtcatgtcgagcgcgctgctcgtgatcgtgtcgtgcagcagccccttcagcgagcggctcatcgggtagctgacgtcgagcttctcgttgacgagcttcgcgtacgcctcgacgtggcgcgcttcgtccatcatctgcgcggcggcgcacaggcgcgcgctcaggccatcctcggccgacgcgagcttcgatgcgcagatcagcgcggcctgctcgccgtgcaggatctgcgacagcagccagccctgcgcgtgatggcgcacctcgcgcttgtcggcgtcggacagcttgctccacagctcggtgccgtagatcagcagcgtcgggtcgggcatgccgagcggattcgccgggtcgaggtcgtggctccagtcgacgtcggtcgcgacgtcccactgcgcggccttcgccttttcgtagagccggttcagcgcctcttcgcgcagcgcgtagtcgttcgacatcagggcgtcgacgggcatcgaccagcggatgtcggccgtgtcctgcataacgatgagcgtgtcagtcatttagggtctccccggccgcgcggcgccggaatgatgggcggaatcggtaagcgtcgtggcggcggcgcgcggtgtcggcggatgcggcacgaggcggatcgcgtacgacggccatgcgccgcgcagttgcgcgtcgaacgcatcggcgagccgcgcgggccagatcgcgcagcacacgcggttgtcgccggagaactcggcatcgcgcaggatccggtcgccgatccacacgacgggcgcgccgcgcgcgtcgcgcagcgcttcgtcgtacaggtgcacgccgagcagcacgtgcggcgcgagcagttcggccggcagcgcgccgaagtacggcgcgcagacttcgatgaacacgcgtgcatcgggatgtaccgcgtcgcggattcgcgcggtcgcttccgcgaggaacgcgaaatactggacgtggtcgagcagtacgcggcgctcgccgccggatgcgtcgccggcgtcgtacggttcgccggccgcttccgcgagcgcggcgcgcgcgtagtcggccggcgtgtcgagcggcatccggtacgcactcgcggcgactgcgaccggctgccgcgcatcgcgctcgatccggtaggtgaagtgaacgggccgcaccatgtcatgcctcgctgtcgagagagaacgtcgcgtccggcgcgaatgcgacgtcggcgaccgcgtaatagccgttcagcgcgagcgagcagacggccgcgcggcgcggcgtgtcgccgtcgcgatgcgcgagcagcaccgacagccacgggtcgctgccgaacgcatgcccgaacagcccgtggccgtcgggcagcaacggcgtcttgccgaccgacgcgagcagcgcgcggcgcgacgtcgccggaaagaacggcagcgccgcgtgcacgccgggccgcgccgcgcagaaggtgcggatgtcgcggccgagccgcacgaccgcgctggccggcggcgcggcgtctgcgagcaccgacggtgcggccggcgacgcttcgcggccgacgtcgacgagcagcgtgcacacgccgaagcccgaacgcccccacgcggggttgccgtgccagtacgtatagccgtgcacgtcgacgtcgacgatctgcaacagcagcgtgcgcggcccggtttcggccgcggtggcgagcgcgcggcgcagcacgtaaccccagcccgcgcattcgtacgaacaggtcatccagtcgggcgtgtagtcgttcgcgcccgcgagcgcctgcgcgaacacgcgatgctgcggcgaatcgttcatcagcagcatcgacaggatcgtcgagctgaccacgtagtcgtccgcgccgaccgcgccgcacagccgctcgcgttcggcgcacgcgagcgagccgatcgcgcgggccgtgtcgtcgagcggcacggccgcgccgtcgcgtgacggcgcgacgcgccggtacgcgagcgcctgtacggtcagcgcggacgccggggccgccggggccaccgggagcggctcggcggcggccgccacggtcgcaaggggcgcgagcatcgtcgtgtcaggcggcgtgctgctggctgcgcagttgcgcgtcgagctgctgcagcgtcgtgtactgcgtgatgttcagcgcttccgggtcgatcgaaccgtagagctgttcgcagaacacgatcagctcgacgatgttcagcgaatcgatgccgagttcgccgatgccggcgtcggtgtcgacggtctcgacattgaggatcttcgcgacttcgcgggacaggatgtcgagcgcgtcggccggaacgttctgggtcgtcatgagaggagctcctggtaatgaagtgggttgatcgggatcgatcggcctgtcgcgtgggtcaactgccggcttcgcagcgcaggctcttgcgaagctcgtgataacaacggtacgaactgccttccatcttcgaaaacgccagcaggtcgcgctggtcgtcgaacgtcgcgacccggccgtcgcgcacgagcgccgtcaggaactcgttcgacagcagcttgatcgcgagcacgcgctgcaccttgccgaagctgtagtgcgcgtcgtcggtctggctgcgcgcggcgtccgcgatgaagcgatggacggcgcgcgcgtcggcgtcgagttcgacgcggccggtttgctcgagccattcgacgtgcgccatcagcgcgcggacgaagtaggggcgcacgacggtcaggtacttgttgaacacggtcgggccgccgatccgcaggcgatcctcggcgctcacgcgcacctggccgccgacgttcgcgagctgcaggttgcccgccaggaacggcgcgccgcaggtcgtgcgcttgagcttgcggtactcgtcgggccacacgaggtacgcggccgggaacatcacgcccggcagccgcgcggcgacgaccgccatgcagtcgcgatgcgcttcgatgccccacaccttgtcgacggtgagcgcaaggccgttatcgtcgctgcgcacgaccgtgcgccaggcggcgaggtcggaccgccgccgtcactcatcaggaacgcgaagttgtggccgctgtcgatgcagtcgcatgcgcgacggttctggtcgtcggagaagaacaacccgaacatgatgcggatgaacgcgcgcatgaacggcttgaacaggtgatgaaacccttcgcgttcgatctggccgagcagcgcttcggtgagcggcgcctcgtcgtgccgcagcggcgtcgatgcggacgaatcgggcagcacgtccggcgtcgcggcgcgcagcgcgatcaccatctcgctgtcgagcagccgcacggcggccgcctcgacgagccgggcggccgcgcgcggcggcgtgccgatggtgccgatcgcgtcgaggtggcgcagcaccggagacgcggcctggtcggccacgcgcagcagcagcggcggcggcaggtcggcggacgaagcgggggcggaaagcgtggacatggggcggggttcctgtcagaagcgcacgcgcacggcggcgtcgatacgggtgccgagaccgaccatccggtactcggaattgctgtcggagaacgcgcgggtgagcgcgacatcgacgctcacgcgcttgttcacgtcggcgacgacctgggcgattgcgagcaggcccttgtcctgcggcgaatacacgccgcgcagcgaatactcgacgcggccgatcttcttgccgagccgcgcgaacaggtagtcgcgcaggttgccgtccgcgctcacgaaatcggcggtgccgccgaggccggccagcgcggggccgggcgcgacgggcagcagcgcgttgttagcgcgcaccgcgccgaccatccggcgccactggttcgcgtcgtaacgcgcctcgtcgtgcgaccactcgacgatcagcgacaggttgccgggcaaggcgctctgcatgccgaccgcgctgcgccacatgacctggcggtcgttgcggcgatcgacggcgtcgtacgcggccggcgaatcgagcggcgtgccgttcgcgatgaaggccggcagcggccgtgtcgtgccgcgttcgagccacgcgctcgcatagacggtgttcgagcgcgcgacgtcgaacgacagcgtcgcgcccgcgccgccgcggccagcatgacgtccggcgagcagcgcggccgagccgcccgaccagttgtacgcgccgcgcacgagctgcgtcgcgccctgcacgtcgcggttgtcgacgtcgttgcgcagcgtacggttctcgccggcgatgaactgcagcgtggcctgttcgccggcccatttcgcttcgacgagcggcgtgccttcgacgtcgccgtagcggtcgtagatgtcggccgtcgcggcccgcttctggaagaagccgagcgggaagaacgcctgcgacgtgtcgagcgggtcgatccgcttgccggcggtgagcgtgatgccgttgtcgaatgcgtagcgcacgccggcctcgttgaagcgggtggcctgcgcgccgagcgaatggttgctcgcgacggcgcgcgcgttcaggaacaggttctcgccgtcgatgcgcgcgagcaggcccgcttcctgctggttgcgcggctggtcgccgatcaggttgccgagcagcgcatgaccgtccatgctgtcgaccgagcgtgcgtaggcgatgccgttcagcgtgctcaactgttccatcagcgattctccgtgcgcgagcgtgcagccaagcgcgagcggaacggcgagtacgacgccgcgccggaggcggctgggcgaggacgagggcggtcacgacgggcgtcggcatgggcgtcgtggtcactggccatcggcaagcgtgtcggggttgaaccagcccgacggaatcttgcgcggctggccgtcgaggatgtcgacgacgctcgcgcgctgcttctcgatctcgttgcgataggtgatcttgcggatcaccttgcgcccgttcgcctcgaccggcgcggagaaatcggcgctgcggaacagcagcccgctcgcgaggaagaactgcgcgcgcaccggcacgtcggtgtcgggcgtgacccacagcttgatcgtcgggtagacgttgtcggggtcggtcgcggtcaggtcgagctcggtggccggcttgccggcgatcgtcgtcgcgccgggcgcggccgacgcgcgatagctgtccgcccagtgcgtgcgcgtgatgtcgctgatcacgacctcgccctgcagccgctgcatcccgttgatgcgtaccgcgctgcgcgtgttcggcacgtagaaccagtggccgcgcgtcgtcgcgagatacttctggccgtcgttctcgccgctgcgcgtcagcgcgagcgtgtcgccgttgccgcgcgtgtagacgagatagcgcgtcgcgtcgccggattgtccgccgacctcgttcgtgatctggatgttcgtctgcgtatcggcggccgtgctgcggtacgcgtcggcacgggcgagcatggtctgggccgccggtgcgtcggctgcgtgggcgagcggcgcgcacgcgaagagcgcggcgaccatcaggcgaatgcggttcatggggcgagtccttcgaggatgttgcgtttggcgagcccgagcgtcgcgagcagtgcggcggccacgccgagcacgacgaacgcgccttcgacggcggccacggcggccggcgagaccgtgaattcgagcaggatcggcttcacgcggcccggcggcgcgggcaggtggatctgcgcgtggttgagcgcgaccatcgtcagcagtgccaccgcgatgccggcggccgcgccgagcaggccgaggaacgcggtctcctggatcagcacgccgcgcaccgtcgcggccggcacgccgagcgcgcgcagcgtcgagatctcgcggcggcgctcgacgatgctcatcaggatccagttgctcatcgacagcaggatcgtcacgcacaggatcgcgccgaacaccgagaactggttcttgtacagcgcgacgacctggtgatagagcgacacgagctggtcccaggtcttcacgtcgagcgcgggcagcgcggcgcgcagcgtcgcggcggcggacggcgtgtgcgccgtgtccgacaggaacaccgcgatgcgcgacgcgcggtcggtgcgcagcagcgcctgcgcggccgcgaacgtcacgtcgacgatccgttcgtcgacgtccttgttgcccgtgctcatcacgccgacgatctgcgcgtcggtcgcgttgatgccgccgtgcgcggtcgaggccatcaactgcacgaccgagccgacgtgcacgccgagcttgcgcgcgagttcggcgccgacgacgacttcggtgccggcattcgcgggcgacaggtagcggcccgacagcaccgtgtgatagtcgaagaagccgggcggctcgcggttcggctcgatgccttcgccgacgaagccgtagctgagatcgccgttcgagatcagcccgtcgaagtcgatgccgcgcgcggtggtggcgacgccgtgcagcgcggcgacggcgcgcgcggcggcagcctgctcgtcggcggtcagcccgtactgcagcggccgttcgccgatcaggtcgagatagccatggtgcagcacctgcacgtggccgacgccgctgtcgatcgagccttcgcgcaccgcgtcgaaggtcgcgatcacgtagccgagcgcgaggctcgacgcgaacgcggcgacgccgatcatcgccatcgtcagcacggtgcggcgcttgttgcgccagaggttacgccacgcaaacgtcgaccagttcacgattcactcccggtacgccgtcgcgcatctcgatgcggcgcggcaggtgcgcgcacagacgatcgtcgtgcgacgcaatcagaaaggcggtgcccagcgtgcggttggtgtcgaggatcagctcggccaccgcgcgcgcgttggtgctgtcgaggctggcggtcggctcgtccgcgatcacgatcgccggctccttggcgagcgcgcgcgccagcgcgacccgttgctgctcgccgccggacagctcgccggggcggtggtgttcgcgcgcggcgagccccaccgcgtcgagcatcgcgcgggcgcgctcgcggcgcgtgcgcggcgtgccccacgcgaagcagccgagctcgacgttctcgagcgccgacatcaccggaatcaggttgaactgctggaacacgaagccgatacgctcgcggcggatccgttcgagcgtgtccggcgcgtcgtcgatccgatggccttcgagccagcgttcgccgctgctcggcacgtcgagaaagccggccaggttgagcagcgtgctcttgccgctgcccgacgggccgacgagcgcgacgacgtcgcgcgggccgatcgagatcgacgcgtcgcgcaccgcgacgacgcggcccgcgccctcgtacacgcgcgtgacgtcgcgcagctcgagcaccggcgtgagcggggcggccgtcatgcgtacgctcctggccggcttcggccgccgccgctgcgtggatgacaggcagcgcaccgttcgcatagaggtcgcggcatttcaggcgctgcagcttgccgctcgtggtgcgcggcaacgagccgggctcgacgaagcacagatcctgcgcggcgaagccgatgcgcgacgcgagcagctgctggcactcggcgcgcgtctgcggtgtcgcatcggcgggccgcgcctcgatcgcgacgaccagccgctcggtgcccgtctccgggtcgggcagcccgaacgcgatgcaggtgctcttgcgcagcgtgcgatgcgatgccagcgcttcctcgatgtcgtgcgggaagtagttgctgccgcggatgatgatgacttccttcttgcgcccgaggatatggagctggccgtccgagacgtagccgatgtcgccggtgcggaaccagccgtcggccgtcagtggcgcggcgatcgagccgtcgtcgggattcaggtagccgagcatcaccgacgtgccgcgaatcgcgacttcgccgacggcgcggttcgcgagggcgtggtcgccgtcgtcgaggatccggaaggccatgccgtcgatcggcgtgcccatcgcgagcacggtttcggtctcggtgtcggcgccgtcgttcgcggcggccggttgcgcgtcgcggcgctcgatcagcgcgcgccggtcgagcgtgtcggcgatcaagtacggtgcgccgtccaccgtgccttcatgccacgcacgatgcatcgataccgcgagcgtcgattcggccatcccgtagcacggctgcagcgccgatgccgcgaggccgtacggcgcgaacgtcgcggcgaagtcgcgcagcgtcgcgtcgtccacgcgttcgccgccgatgaagatgttgcggcacgcggacaggtcgacgccttccatcgcggcggcgttgaagcggcgcacgcagtagcgcagcgcgaaggtcggcaccgacgtcgtcgtcgcgcgcgccgacgcgatgcgcttcagccagccgagcggattccggatgaagctgttcggctgcatcatcagcagcggcgcgcggtaatgcaggttcgacagcagcgtgagcagccccatgtcgtgatagagcggcagccacgaggcggtgccgtcaccggccgcgatgtcgaagcggaccgacccgccgatgccgagcacgttcgcgatcacgttctcgtggctgagcaccgcggctttcgggtgggatgtcgagcccgacgtgagctgcacgtgatgcgggtcgtggccgctcttcgcgctgatcagtgcgcgcgcgccggcatccgcggcgatcgacagcgtgtcgagatcgaccacgcgcgtcgatgccgcgggaaacgcgtcgtcgcgccacgcggcggcccgtgcatcggcggcaatgacgaggcgcggccggtacagctcgcacgcgacgtcgatcacttgcctgccggcggtcgcgcggcgcgcaggaacgggcacggtgcagggcagcgcgcccgtcatcacgcaggccatcatcgcgaccgcgtgctcgaccgatgcgggcaaggcgagcatcaccaggtcgttctcgcgcacgtcgagttcacgcagcgcgccggcctggtgaaacacttcttccgcgaagcgccggtacgtgatgcctgcctcgttgccggcctcgtcgacgaacgtcatgcgatgcgtggcgcccgcgacgtcctcgagcgattcgatcaggcgatgaatggtggatgcgcacttcgtcacgagaatctcccgttgaggaatacggccgctcgtgccacggtgccggcggcgccgttcgtcgagtgaggggattcttgccggatcgacgtgacgcgacaaacggaatatttgcaggctatgcatgagcggcacgcatccactcgtgtctgccccgcacgtatgcatctgaacccgcgtcaggtgaatggccggtacgcattcgaccggtcgtctagttcacgatgtggtgcgctcatgcgcgggcgtcatgcaatgcgttcggaaaattcgtttgtccgaagcatcgactcacagaagaattgcaacccggcagcgcgccagcgtcgccgtgtcatggcgccgggcagggtccggctcaaggagagcgtcttgtccgtcacctcatcgcttgtcgcccgtcagaaaccggttgcagacatgaagagccgcccgagcggcgtcgtcttctcgctgaagctcgcggtatacgtcgcgctcgttgcgcacggcatgctgttcgcgctgtcgacgtatgtgatcctgaagatcgtcgggatcctgctgatcggcgcgatgtacgcgcacggcgtcgagctgcagcaccaggcgctgcactaccaggggttccggagcaagcggctcaacatggtgttcggcgtgctgctcggcatgccgatgctggtgtcgttccacgcgtaccaggacagccacctgcgtcatcaccggctgctcggcacgccggagaacaaggagttcttcgactacggcgaccagtacggcgcgagccccgtcgtcaatctcggcctgtgggcgtggcggctgtcgatggccgcgcactatatccagttcgcgaagaacgtcgcgaagctcgtcgtgccgggggcgcgcttcggcgacaacccgctcgtgtcgcgcgcgatccgccgcgatcacctgctgatggtcgcggcgatcgcgctgctggccggcgtgtcggtcgcgctgcacacgtggtttgccgtgtgggtgtgggtcgtgccgctggtgttcgtcgccgcgcccgtgcatgcgctggtcgagatgcccgagcactaccgctgcgacctgacgagcaccgacccgttccgcaacacgcggacgatcgagagcaacgcgttcatgacgtggttcacgaacggcaacaactatcacgtcgagcaccacatgatgccgaacctgccgatcgagcggctgcacgacctgcatggcgcgatcgggccgcgcatccgctattaccaccgcacgtaccggcagttctattacgcgctgctgcgcggcaggctggcgccgcgcacggtggacgacgatgcggacgagcgtgcgcccgatgccgaaacggcggcgccggcgtccacgcaatcggcatgaccgcgacggggccggccgcccgcgtgcgtgccgtgccggaacgttgttcaacgacggtgacgacgatgctctatccggaattattcaggtcgctggaagcggtgcgctggaacatggagacggatattccgtggaaccggttcgacgcttcgctgctcaccgacgagcaggccgagacgatcaggatgaacgcgatcaccgaatggtcggcgctgcccgcgacggaaatgttcctgcgcgacaaccggcacgacagcgacttttccgcgttcatgagcgtgtggttcttcgaggagcagaagcattcgctcgtgctgatggaatacctgcgccgcttccggccggagatggtgccgaccgaagaggaactgcacgcggtgcgcttcgaattcgacccggcgccgccgctcgagacgctgatgctgcacttctgcggcgagatccgcctgaaccactggtaccgctgcgcggccgactggcacaccgagccggtcatcaagcagatctacgaaacgatttcgcgcgatgaagcgcgccatggcggcgcctacctgcgctacatgaagaaggcgctgaacgactgcggcgacgtcgcgcgcgcggcgttcgcgaagatcggcgtgctgatggcgtcggcgcgccgcacggagaagccgctgcacccgaccaacctgcacgtgaaccaggcgctgttcccgcgcgataccgtgcagtcgcgcctgcccgatccggaatggctcgagcgctggctcgacgaacagatccggttcgacggcgagtgggaaaagaaggtcgtcgagcggatcctgcacaacctgtcgatcctgttcgagcgcacgttcgcgaccgcgcaggagctgaaccgctatcgccgcgaagtgaccgcgcggacgaaccgtgtggcggatggcgtggtggacggcgtatagcggatgcgtgtcccgtccagcgtgggcggaaccgattccggccggcaagatgacgtagtgcgcacggtgtccggtatccggccggcgggatattcatttccggacataatgggttcatcaatttcctgttattgcatgattgaatcaaatttcatgcgtttagtatattttcataaacatgaaattcaggatttaaatggtattttgcgtgtatgttggcgtgtgttttctttccgtaatgcggcaaatgaaatgatatgtcgggtgattgaaattatattgtaggcatgaggcgcgattccggtgtggcgtcgagatgtccgccgtgacatcgatttctgcccgcaataccctgttttggtgggtatttttcggccattcctcgcgtcattccacccggatattcatttacaaaatcactacttaataatgttaatgtaagaatatcgggccgactaaaatcgatagataaatacgagtgtcacgattgaaaataagaatgatcagcatccattcttcaatataaaatcgcttccgaatccaaataggagaaacgattcaggggaacgaaaggcgacttgcctgtcgatgggtgcaactttgaggcggcggtatggctaatgtgagattggcaaaacgattgagaagtatgccttcgctggatttcctgagaggcttcgaatgcgcggcgcgtcatttgagctttacacgcgccgggcaggaactgaacgtcacgcaatctgccgtgagtcggcaggtcaaggcactcgaggagcagctccggatcgagctctttcaccggcacattcgatcgctgacgctgaccgacaagggacgggagctgtacgacgcgatctcgttcgcgttgtccgacctcgaatcggtgatcggcaagctgtcgtcgagcgtgggacagcgcgcgatctcgttgtcgacgaccgtatcgttcgcggcgctgtggctgattcctcgcctcggttcgttccgcgcaagctaccccgacatcgacgtgcgcgtatcggcaacgagcgaaattgaggatctcaagcgcaaacgtttgcatttggccgtgcgatatgcggggccgtacgtcgacggacgatacggacgtgctgtttcgcgagcgcgtcgtggcggtctgcagcccgagcctgatggcgacggcgggcgacgcggcgtcgatgaagccggaggaccttgaaaagcacgtgctgctgcatctcgacgatccgcgctgcgaatggccgtggcacgggtggagccatctgctgaaggaactcggcgtgccgcgcctgcggccgccggcgcgctgcatttcagccagtacgaccagctggtgcaggcggcggtcgacgggcacggcattgcgatcgggcggcggccgctggtcgacgggctgctgaagcagggccggctcgtcgaactgttcgcgcactgcacggtcgcatcgggcagttacgtgctggtgcagaacccggatgcgtgcaacgagttcgacatcgcggtgctgaccaactggctgctcgaacaggcgcaccatccgctcgcgtcgggccaggaagcggccggcagcaacgtgctgccgatgtatcgcgtcggataggacggcacgcggcgtgccgccgcgcacgacgtcggtgcgatcgacgcgccatgcggtgacgagcggcgtcgtgccgccgaacggcgacaccgacacgttgaagccgatcgcgagcgcgtgtgcgcttgccatacgggggacaacacacgatcgcggcgtcccgtggtacccggtgaaatcgatcgtgccgatcgccgtgcgtccggcgacgttcacgatcacgacgttgccttccgtcgcgatccgcccgtcgttggaaaaacggtcgcgtagcgtgcacggcatcgacgaaaaacgcgcggccgcgaggcacgcgcgcaaactcggagatcgttagccggtggcgagtcagttgccgttcgacgcgacggtgttggctgcgcccgcgcaatccttctgatactcgttcatcaggcgcgcctgcgccgaatcgatatcgtccggatagctgctctcgtcgcccgacgacgggttgtagccgacggattccagctcgttcagctcgttgatcagttgccggtgggagaccgggccgtgcgtatgcacgaacggatagtcgtggcattgcgccggcgtgagtgtcggcgcggcatgcgcggcgaagctcatcacgagcagcgcggaacaggcgaggtaacgggcgggatgtttcatcttcgactcctgggaagcgttgggaaccggccgtacggtggattgccaacgtcgacctcacgacacaggttaggcaccgtggactatcgaaacggccgcgcgaagatgaaactagttttatccggatcgaccgcgcgcggaagcgatcgtcgtcgcacgcatcgaaccttaaagaaaccttcatgcacgcgcgaccgaacggttagccgtgcgggcgtatcgtcgaacccgtgatcaatcgacgctgcgcacggcgcggcccgcatcggggtaatgcaatgaaagagaccgtcaggatggccgcgctcgtcgcgctggtgtgctcaccggtgctggcgttcgcgaaggtgcagggaacggggctcgcgattgccgacgtgacgctcgcgcacgagaaggtcgagcgtacgcagcgtgtggagaacgcggcacatcgtgtcgcttcgcatcgcgtcgaccagcccggcgcggagccgcaccgaagctgatgcgcgattctttaccgatacctttcgacgcgatcggttgcaaccgcccgtgcgcgaaggcgaagggctgtgcggcatcctgtcgcaacaacgcgcgccggtagccccggcgggcgttgccgccgtatatgaaactttcttcatgaagtcgacgcgcacgatttacgcgcgcgcgtgtagtctccatccgaacgcgctcgcccttcgggtgtcgaagcgcgtgcgtcccttcgctgaagacgagaatcgtaaatggcatcatcagtttccccggtaacacgccggccctgcccgaccggccggccgagagcggtacggccatcgcgcacgtactgacgatcgaagacgacgaaatcaccgcgaacgaaatagtcagggaactgcaagggcgcggcttcacggtcgaatgggtggcgaacggccgcgacggcatggcccgcgcgctcggcaacgagttcgacgtgatcacgctcgaccgcatgctgccggtcgtcgacggcctcacgatcctgaccacgatgcgcagcgtcggcgtgcgcacccggtgctgatgctgagcgcgctcggcgatgtcgacgaacgcgtgcgcggcctgcgtgcgggcggcgacgattacctgaccaaaccgttcgatcccgaggaaatggcggcgcgcctggaggtcctgctgcgccggagccagaccgcgccggcgccgttcgccacgacgctgaccgtcggcccgctcaggctcgacctgatctcgcgcaaggtgtttcgcgacggcgacgaaatcgcgctgctgccgaccgaataccgggtgctcgaatacatgatgcgcaatgccggccagaccatcacgcgcacgatgctgttcgaggccgtatggggctatcacttcgatcccggcaccaacctgatcgaagtgcacatgggccggctgcgcaagaagatcgatccgcccgatgcgaagcagatgatccagacggtacgcggtgcgggctacatccttggctgagtccgcgaccttgatgtcctcgacggatcacgtccagccggcgccgaagcgtcactggtattccagcacgttccggctcgtgtcggtctacgcggtgacgttttccgtgtcggtgatgctgctgctcggcttcatcgcatcgatcatcacgcacgacatggagcgcgaaaccgacgtggtgatcgactggcagatgatctacttcgattcgctccaggacaaccagcttgccgcggccatccagcaccggatcgagcacgagcggatgcacaccaactactacgggctcttcacggccgacggcaggcatgtcgccggcgacgtgctggccatgcccgacggcatccggccggatcgcaccggcgtgacgctcgaccacacgatgacgatcgcgggcgaccaggtgccgccggtcgtccgcacgatggcggagcggcgcgccaacggcgacgtgctggtgctcgggcgcgacctgacgcacatcctgcggattcgcgcggcgatcatccaggcgctggtcggcggcggcctgttctgcctgggcgcgggcgtcgtcggcggcctgattctcagcgtgcggcagatgcggcgcctgaaggaagtccggcgcatcacgcagcgcatcgcgcagggcgacctcgggcagcggctgccgatcggcgggcacgacgagatcgacctgctgtcgcatctggtcaatcacatgctcgaggaagtcgagcgcctgatgaacgaggtgaagggcgtctgcgacggcatcgcgcacgacctgcgcacgccgctcgcgcacgtgcatacgctgcttgcgcatgcggcggagcgcgcggacgggctcgacgatgccgcgctggcgacgctcgtcgcccgcgcacgcaacgagaccgacgtgctgctcagccggtttcgcgcgatgctgcgcatcgccgaaatcgggtcgctgcagcggcgcggcgggttcgccgaactcgcgctggaagatctcgtcacggacgtcgggcaactgttcgagccgctcgccgacagccgtgccatccatttcgtcgtgctcgtcgaaccggtcgcgcggattcacggcgatcgcgcgctgctgttcgaggcgctcacgaacctgctcgacaacgcgctcaagtacacgacctcgggcgacaccgtgcgcctcgaacttcacgatacgccgtccggtccgcgcatcgacgtggtcgacaacggcccgggcatcgcggcgaacgagcgcgaggccgtgctgcagcatcgttaccgcagccgccgcaccgggcacctcgccggggccgggctcggcctgagcatcgtgtcgacggtcgtcaacgtgcacgacttcacgctgcgcatcggcaatgccgagcccggtacgcgcgtgacgatcgaatgctggccgaggtcgctcgcatgacggtcgttcgcatccggctgcacgtgcgcgcgcattgccgccgcgaggcgggctgacgatgcgcgtgctgctcgtgacttcgccgcacccggaagcagcgtggctgtacaaggcgctgcaggagagcgggcacagcctgcagcgtgcggacgatctgcgcgacgggttgttcctcgcgtcgcaggagacgttcgacgcgatcgtcgcgaccgcgttcgagccgggcagcgatgccgcgctgatcgcgatgctgccgcgtttcgtcgccgacggcggcggtgcggcactggtggtgctgatcggccaggcatcggcacgcgagcgcatccgcgtgctgcacgcaggtgccgatgcgtgtttcggcgcgccgtattcgttcatcgaactgcacgagcgcctgcaggcgttgcagcggctggccgggccgcgcgacccggaaggcccggtcgcggcggtgtccatgctggagacgctcgcgcgcgaactcaaggacggcaagctgcgccttgccgtgacgcggcgcgaatgcctgctgctcgaatgcctgatgcgccatccgaacgcgccggtgccgcgcgaccagttgatccggtatgtgtggcaggacaaggacgatgtcgatccatcgagcgtcaatctcgtggtgtcgcggctgcgccgcaagctcgcgcggcatctgcccgatgtccggatcgatacggtgagccgctacggctaccaggtgacgctgccggacgcatagccgcgcggccccctgtacgaacgggcgcgttgtcgatggcagcgcgcccgtcgtgcgtttacgagccgaagaacggcacacagaaatcgggcgggccgacgcaatcgccggggccgtcgggttgcgcgccggcgcagccggacagcatcacgccggccgcgatcgcgacgagcgcaacgcgggcggaacgaacgagcaagggacgaagcttcatgaatgacgggtgatgcgagaggtgggcggcgcgcgccgggcagcacgcccggccgcgcggcggtgcgcatcaatgcgaatagagcgtggagtcgaggtacttgatctgcccgtcctgttcggcgtgcacgagttccgcgtagacctgggcacgcgttttctcgtggatcggctgtccgtacggcggcacccactggcccgcggcctgcgcgccgggcacgccgtccttggtggcggccggcgtcagctgcatcgcgtgggtactcgtttgcgcgaacgcgggaacggacagcgcggcacacgcggcgagcagcgtggaggcgacgattgtggcggttttcatgttcggaatcctcatgatgattgactggatcatccccggtgcggccagtcgatgccgcgcgtcgggttgaggacaagcatagggagggggctatcggatcggcatacgcaacgtgaaaagaaattcatgcgccggcgcgttccgcacggacatgaatgcggcgtatcgcgaggatgaagaaggtttcatttttcgggccgtttcgataacggcgctgtcatgcccgctgcctaaattgtgcgccatcgcatcgcggacggagcggccgttccacaccggccggcgatgcgagaagaccgatccactctagcgaaaccatcatgaagaaacttctggcaatcccggcagcggctgcgtgcctgcttgcaggcgcggcgcatgcgcagagcagcgtcacgctgtacggcacgatcgacgcgggcctggactacatcagcaaccagaaatcggcggccggcgcggggcccgcttacggcgtgcagagcggcaacgtcagcacgtcgcgctgggggctgcgcggcaacgaggatctcggcggcggcctggccgccgtgttcaccctcgagaacggcttcaacgtcgcgaacggcaagttcggcaacggcggcgacgagttcggccgtcaggcctgggtcggtctcgcgagccgccaatggggcacggtgacgctcggccggcaatacgatttcctggtcgacttcgtcgcgccgctgtcggcgacgggctcgggattcggcggcaacctcgccgatcacccgtacgacaacgacaacctcgccaacgacacgcggatgaacaacgcggtgaagttccgcagcgcagactacggcggcctcacgttcggcggcgcgtacggcttcagcaaccagggcggcgggttcagcaacaacaacgtgtacagcgtcggcgcgcggtatgcgaacggtccgctcgacgtgggcgtggcgtacctgcagtcgaaccagccgggcggcgtgaatgcgccgaagaacaccggcggatcgctgagcagctcggacggcgatgcgatgctcgcgggcggacgctggcgcacgttcggcgccggcgcgcattatgcgttcgatcatgcgacgatcggcttcgtctatacgagaacgatcctgaacgacccgcgcgaactgtcgcagggcggcgcgtacggcaccgtgaacggccagttgctgaccttcagcaactacgaactgaacgggcgctacttcctgacgccggccttctcgctgggcggctcgtatacgttcacgcagggccgcttcgacgatgcgggccgcagcatcgcgccgaagtggaaccagttcatgctgcaggccgactatgcgctgtcgcgccgcaccgatctctatctcgaaggcgtgtatcagcgcgtgacgggcgcggacggtgtcgcggtgctcggcaacgcggggatcttcaatctggccgcgtcgggcaacgatcgccaggcggtggtcgcggccggcatccgtcacaagttctgaccggccgggcccgcgaaaaatgcacccgtcgcgatgacgggtgcatccaaacgcgacacgctccccacgtgccgcaacgggctcaggtcgtcgaacgcgccggcgtcgcgaccggcgttttcgcgccggacgctgcttcgtcggccgaccaccctccgcccagtgccgcgatcaacccgaccgccgccaactgccggcgcgtattcagttccagcatcgccaccttcgtctcgagctcggtagtctgtgcggtcaccacgtcgagatagctgacgacgccgtcccgatagcgcgacatcgacaactgcaacgtgcgttcggccgcgtcgagcgcttcctgttgacgatcggcttcgtcgccgagatggtgcgtgagcgcgaggttgtcttccacctgctggcacgcatcgagtaccaccgcgcgatatttcgcgccgttctcggccagctgcgcgtgcgcctgggccgtgagcgcctggcggcggccgccgtcgaacagcgtgagcgcgaggctgggcccgatcgaccagatctcgttcggcgccctgagccaatggccgagccccgaactctggtatccgccgatcagcccgagcgtgatgtcggggaagaacgccgcgcgcaccacgccgatctgcgcgttggcggccgccatgcggcgttcggcggccgcgacgtcgggccgccgttgcagcagcgtggcgggaatgccggccgggatcgcgggcagatacgccacgctcaggtccggcgcgagcgcgaacgacgaggccggcacgccggtgagcgtcgcgatcgcgtgctcgtacagcgcgcgccgtgcccgcacgtcctcggccgacgcgcgggccgagtcgagctgcgtctgcgcgcgcgagacgtcgagatcggatgcgatgccgcccgcgtgccggctcatcgtgagtttcagcgcacgctggtacgtgtcgatcgtgtcggacagcaactgctgctgctggtcgagcccgcgcaggttgaagtacgcgttcgcgaggctggcctgcaggctcagctgcaccgatgcgagatcgtcggcgctggcctgcgcgttcgcgcgcccggccgcgacctcgttgcgcaccttgccccacaggtcgaggtcgtagtcgaagccggcgtcgagcgtgttcgagccgtacacgttcggctggttcgcgccgcgcagcgggcgcgtggccgattgccggttgctcgagacctgcgcgccgaggccgatggtcgggaacagccccgcgcgcgcctgatcgaacagcgcgccggcttcgtcatggcgggccaccgcggcggccacgtcggggttggcggccgccacccgcgcttcgagccggtcgagcaccggatcgcggaacgccttccaccagccgtcgcgtgcgatgcggtcggccggctgtgccggctgccagccgcccgcttccttgaattgggcaggcagcgtggtctgtggcggatgatagacgggcgcgaacgagcaggcggagaggaacgcgatactggcgagcatcgcgcagagccgacgcgggttagccattcgcacgctccgtgtcgcgcacggccgccgcgacggtgccggccggcgtcgcgagccggacgcggtcgcccgcggacagcgagtcgggcgggttgtcgatcacgcgatcgtcgggcgcgaggccggtcgcgatctgcacgtgcgtgccgaggtcggtcgcgatcgtgacgggcttgagcaccgcgcgatcgtccttgccgaccacggcgacctgaaggccggcctggcggaagatcagcgagctggccggaatcgtcaacgcgtggctgctgccggccggcagtgcgaaatgcacctcggtgtattcgcccggaatcagcttgccgtcgcggttgtcgaccatcagctgcacgagcagcgtgccggtcgaatcggcgatcgaatcgtcggtgtcggcgagcgtcgcatggaaggtctcgtccggatgctcgggcacggtcagcgtcgcgctcatgccggggcggatcgcggcggcctcgttctgcggcacgctcacgtagacacgcatccggtgcacgtcggacacggcgaacagttcggggccggcgccgccgccggccgagatcagctggccgatgtcggtcttgcgcgcggtgacgacgccgtcgaacggcgcgacgatgcgcttgaacgcctccagcgcgtcgagacgccgcacgttggcctcgttggccgcgacgatcgcctgcttggcggcgaggtcgctggtcttctcgtcggtttcctgctgcgacacggaatcctgcgcgagcatcctggtccagcgcgcggccgtggacgcggccagcttctcgttggcgagcgagctctgcaggtcggcgcgcgcctgctgaagctgctggtcgagctcgggcgtgtcgatcaggccgagcagctggcccgacttcacgtgcgcgccgatatcggtgtaccacgcacgcaggtagcccgacacctgcgcatggatcggcgcgctttcgaacgcggacaggtggccgggcagcacgagcgcggcgccgtcgccgctggtagtcggcgtgtaggcgaccacggtcggcaccgcctgttcggcggaccatcgggtcatttcctgtttcgcgtgcgcgcggcctgcgatgccggccgtcacgatgccgaccgcgaccagcgcggcgatcgtggcgacgagcttgaggttgggcagccgtttcggcgacttgatttcgatctcagtggacatgggaagctccggacgcggaagggaaggaagcgcggggtgcgtcgtgtttcagcgcatcgcgccgatgcacgaggctgaacacgacgggaacgaagaacagtgtcgcgatcgtcgcgcacgcgaggccgccgatcacggcgcggccgagcggcgcgttctgctcgccgccgtcgccgaggccgagcgccatcggcgccatgccgatgatcatcgcgagcgcggtcatcagcacggggcgaaagcgcgtgaagccggcttcgagcgccgaggcgagcgcgttgccggtttcggcgaggcgctcgcgcgcgaagctcacgacgaggatcgcgttcgcggtggccacgcccatgcacaggatcgcgccggtgagcgcgggcaccgacatcggcgtgtgcgtggtgaacagcatccagacgatgccggccagcgccgccggcagcgcggaaacgatcacgaacgcatcggcccacgagtggaagttcacgacgatcagcaggtagatcagcacgatggcgcccgcgagcccgagcagcaggccggtgaacgcgctgttcatggtctgcacctggccgcgcagcgtgacggtcgagcccttgggcaggtccttcgcggtggccttgacgatgctgccgatgtcggcggcgacggcgccgaggtcgcggccctgggtggtcgcgtagatgtcgaacagcggttcgatgttgtagtgcgacaccaccgcgttgccgacgccgcgcgtgatcgtcgcgagaccgccgagcagctgcgactggccgttcgcgccggtgacaggcaggttctgcagcgccgacagcgtggtcatccggtactgcggcgtctgcgcgacgatcggataggacacgccgttacgcggattgagccagtaggtcgggtcgacctggctggtgcccgcgagcgtcgcgaccaccgagttcgtcacgtcctgctcggtgatgccgagctggtcggcacgcgtccggtcgaccgccaccgtgaactgcggataggtgctggcctgctggatgcgcgggtcggccacgccggcgatcaggcgcagcttgcggtacagctcgcgcgcataagcgaggttggcctgctggttggggccggccacctgcaggtcgaccggggccggtgcgccgaagttgaggatctggctgacgatgtcggcaggcaggaacgagaacgtcgtgcccggataggcgcgcggcaggcgttcgcgcagctcgcgcacgtagtcggcggtcggcgcgtggtcgtgcgacagcgagatcaggatgtcgccgtcctgcggtccgagcgtgccgctgttgttgtaggtcaggttgatcccgctgttcggcaggccgatgttgtcgaccacttcgcgcaactgcgcgggcgggatcacgccgcgaatcgtgttttcgatacggtcgaactcggcggcggtttcctcgacgcgcgtgccgaccggcgcacgcacgtgcagcgagatctcgcccgagtcgatcgtcgggaagaagttgcggccgagccacgggacaagcaggaacgatgcggccaccacacacaggaacgcgacgacgaacggcttgcggcgcgtgagcgcgaggcccagcaggatccggtacgacgcgcgcacggactcgaagcggcgctcgaatgcacgctggaagcgcaccagcggattgcgcgacggcggcgcgtcgtgcgcgccggcatggcccgcatgcgaatccatgatcgccgcgagctcgcccgacgcatggccggccgacgcgtgcggcttgagcaggtattgcgcgagcatcggcacgaaggtgcgcgacagcacgaacgacgacatcatcgagaagatcaccgccttcgccatcggcacgaacaggaagcgcgagatgccgtcgagcatcagcatcggcacgaacacgatgcagatgcacagcagcgagacgagcgccggcatcacgatctgtttcgcgccgtcgacgatcgcggtgcgcgtgtccttgccctgttcgaggtgccagttcacgttctcgatcgtcaccgtcgcgtcgtcgaccagaatcccgaccgcgagtgcgaggccgccgagcgtcatcacgttgagtgtttcgccggtcgccgcgagcagcgcgatcgccgagagcacggccagcgggatcgacgcggcgatgatcagcgtcgagcgccacgagccgaggaacagcaggatcatcagcgacgtcagcgcggcggcgatgatgccttcgcgcgccacgccgctgacggcgccgttcacgaaggtcgactggtcgcccatcgtgacgagcttcaggcccggcggcagcgtctgttcgaccagcggcagcttcgccttcacgcccgcgatgatgtcgagcgtcgatgccgagccgttcttcaggatactcatcagcaccgcgcggcggccgtccacgcgtacgatgttgccctgcggcgggtagccgtcacgcacatgcgcgacgtcacggatataaatcgtcgtgccgtcgaccgacttgatcggcaggtcgttcaacgcgtcgagcgagagcgggctgttgttgagcttgatgttgtattcgaagcggccgatcttctgcgtgccggccgggatgatctggttctgctgcgcgagcgcgtgcgcgacgtcctgcgccgacagccctttcgactgcagcgcttgcgggtcgaggtcgatctgcacttcacgtgacttgccgccgtacggcgtcggaatcgcgacaccgggcaccgacagcagctgcggtcgaatgaagttgaccgcgtaatccgccagcttctgttcgtcgagcgtgttgctggtcagcgcgatctgcagcacggggacggtcgacgcgttgtagttgaggatttgcggcggcgtggtgccgggcggcatctgtttgagcacggtctgcgagatcgacgtgacctgcgcggtcgccgtgcggatatcgacggtcggctggaagaagatcttcacgatgccgtagccgcggaacgattgcgattcgatatgctggacatcgttgaccgtcgtgccgagcgtgcgctcgtagtacgtgatcacgcgtccggacatgtcgtccggctgcaggccggcgtagttccagacgacgctgatcaccggaatgcggatatccgggaagatgtcgatgggcgtgcggagtgccgcgagcggacccgcgatcaggatcagcagcgccagcacgacgaacgtgtagggccgggtgagcgcgagccggacaattttcagcatggggtgctgctccgttcaaaagcgtcgtgaagaagagccggatgcgcgcggcttcgggaaaacaccgatacgcagccgatgaccgcattctgcggagcggcccctaacagccggtcgctaaaaagatgaaagaagttttaggtggcggcggccggattcagccgagcatgtagcccgagccgcggatcgtgcggatcaacggtgccgcacccggccggttcaccttcttgcgcaggcggccgacgtggacgtcgatcaggttggtgcccggatcgaagcggcagccccacaccgcctcgaagatcatcgtgcgcgtgagcacgcggccggcgtggcgcatcatgaattcgagcacgcgcaattcggtcggcagcagcgcgagctcgctcgcgccgagcgtgacgcggcgccgcaccaggtcgaatgcgagctcgcccgcgcgcaggaccgtctcgacctgcgcgccgcgcggccggcggcggatcagcacgtcgatgcgcgcgcacatctcgtcgagcgagaacggcttgacgagatagtcgtcgccgcccgcgcgcagcccctggatgcgctggtcgacgtcggacatcgcgctcatcacgagcaccggcgtgtcgaggccgacgccgcgcatcgtcgcgagaatcgtgagcccgtcgagatccggcagcatgcggtcgagcgtcacgacgtcgtagtcggcactcatcgccctggccatgccgtcgcggccggtgcgcgcgacgtccacctggtggccggcggcgcgcagcgtctgggtgatgtgatccgcgatcagcggatcgtcttcgatcgtcaggatgtggggcatggacggagcggcccgggcggaatcaggcggcggcgcgctcgggcgcgcgatagtgttcgaccacgtagtcgatgaagctgcggaccttgctcgacagatggttgcggctcgggtaaagcatcgagatgcagcgcgcgccgccgttcacttcgtagcgttcgagcagcggcaccagcgcgccgcgtgcgagatcgtcggcgacgagcgggtgcggcaattgcgtgatgcccatgtgattgagcgccgcgattcgcaccatcatgctgccggtcgaggccagcgcgttgccggtgtagacgcggtaggaaccgtcgacgtccgagaattcccagctgcgcgcggtgccgttcgacacggtcagcaggctgtgttcgttcagttcgacgggatcgttcggcgtgccgtggcgcgcgaggtactcgggcgacgcgacgaccacgtcgcgcacgctcgtcagcatccgcgacacgaaggtcgcgttgacgaggcggcgatcgtcgcagaagcagacgtcgtagccgccctcgaccatgtcgacgtgcgtgtcgaacgtggtcacgtcgaaccggacgcgcggatgcccgtcgcgatacgccgacagcagcacgccgaggccggccgcgacggaggtcgccgacgcggcgatccgcagcgtgccgcgcgggtcgcgcgtgacctgcacgaggttcgattccatctcgtcgagcttctcgatgatcgagcggcaaccgtcgagatattcgcggccggtctcggtgagggacaggctgcgggtcgtccggttcagcagtcgcatgttcaggtgcgcttcgagcatgccgacgctgcgcgtgaccgcggccgccgacatcccgagctggcgcgcggcgagattgaaactcgacaactcgactacacgcgtgaacacgcgcatcgcttgcagttggttcatggtccgccgaaggaaagaattgaccgttcgcatgcgccgccgacgcatcgctcgatgcgtgccgccgcgcgtgaccggcaaggtagcgagccgattatgggatgcgggccggcgccggacgcttaaaaacgacgcggaatggatgaaatttcgtttaaggaagcggcggacgaccatgccatcgagatcgtcgtgcgtcgtgacggcgaatacgcgattgtcgcaacggcagtcaacctaaaaataaattcatgaagctgcatcaaatcttcaggtgcgcgcgcgacgcggctgccgataatgggccgatacgagtagccacgaggaacgcaataatgacgcagccgctgagtatcaagatgatccaggaacacggcaagccggtggtgctggtgtcggtcgaacggggtgccgcggtgctcgatccggaggacgtcgacgcggtcatccagtatctgagcctgttgcgcgcgtcgatgcagccggccgtgcccgagatgccgccgcgcgcgcagcagttcgtgacggagatggacccgtgctggtatgcggagcgccatccgctgtacggcggcgcggtgctgttgctgcggcacacggggctcggctgggcgagtttcgcgctgccgccgcggagcctcgagcgtctgcacgggtcgctcacgcaactgctcgaggacgagcagatggtggtcagcctgccgaactgattcggcgcgtgggtcgatcgcgccggccggggcccgcttccggtacacgggaagccggcttcttcgcgcgatcgcctagaacgtgtggcgcagcccgatccggccgaccgcctgccggccgctcgacgacggatcgaagcccgcgacctgcgcgacggcgccgcccgacgccatctgcagtgccgcgagtgcatagatcgccgtgcgcttcgacagcgcgtactcggcgctcgcgttcagttgccggtagtcgggttcctggccggtcgcatggtcgcggccggtcgtgtaggtgtagccgaggccgaaattgagctggctcgtggcggcgagcgtgccggcgatctcgtagttctggaacttcacgtcctgcgcgtcgtcgccttgctggaaatcgacgttggtgaagttgcccatcagcttgacgttgccgatctggtacgacgcgccggccgcgaagatgttctggctgcgcgcgttcatgagcgcgtcgccgtacaccgcgttcgtgtatccgccgccgttctggtagctctgcacagcctgctccggatcgttgacgcgcaggtagccgacgccggccgagaacggcccgttcgtgtaggcgagcgccgcgctgtacgcggcgttgtcggagaagcggccgggctgcccgccgaacgagtagagcgcctcggcggtgaagccggcgatcgtcgggctcgtgtatttcacggcattgctgatcgcgaaaccgttgtcgaggttgtccatgtcgttcgggtgcgagaaataccagcccccgtaatagtcgttcagcgaatacggctcgatcaggtcgacgatcggatcccactgccggccgagcgtcagcgtgcccatgcgttggtcggacagcccgacgtaagcgttgcgcgagaacgcgaggccgctgccgagcccgccgttcgtggaattgaagccgctttcgagatcgaagatcgcggcgagcccgccaccgagatcttccttgccgcgcagccccagcggctgccggcgctgacgccgctcgccatctgccacaggtgctggccgtcgacgttcgacgcgaagtcgatcccggtgtcgatgacgccgtacagcgtgacgctgctttgcgcatgcgcgtgggagaacaggccgcagcaggcgagtgcgcacgtcatgcgcagcagccgtgtcgttttattcatggatgaaggtctcgaacgtaggttgacggatattattcgcagtccttgtttaaagggctggtcgtcgagaatatagctgcgtcaaaagcgtgcggatcggcaattcagtctttcagtttttgcgttggtttcgtgcctgtgggcggtcgacaacgcgggtgttgggcgctgtggattgttcgcttcggggtgggggcttgggggatgactccgcgcttcgcaacgcgaccgacattgacgacatcgatgcgcagcgcgccagcgtttgaatatgcctggatcttgaggtttccgatcgacgatgacctgcgagttattttcaggtcaggcgcaattttcagcaaaataataattcgtcccgatccggattttgaatgattggcgggtttgatccaattcaaatatcaatcgacgaatcaaattgttgagcaatggaggcggccattccggtggcctccgaacgcgaaattccgggatcgatcattcacgatcgtcaaacgccagaatccgcgttacgtcagggttgaagggcgaagaatccaggaatggatgattcgatgccgcgaatcaaatgattatcaatgacggacgtttatttttccggtttttgcggataaggttcgactcggtgaaagtgatttgtcaggaagcgcggcgattgatcattgcttgccgcggtttcattcgaccgccgctttcgccgatcagcatgcgcgacgacgcgtcgacaggaatctcttcgcggaatccggcgacaggctcgatgtgcgcatatccgtttcgacattcatgccatgagagggctcatgaacaagaacatccgcagctacgttgcttccgtcatgccacgcgcgctggccggtgcggcactgctggtcgcggcggccggtgcgcacgcgcacggccgtttgaccgaaccgccttcgcgcatcgtgctgtgcacgcaaggccagaatccgaactgccctgtcgacgcgtggcacgctaacgcgatggagaacggcaagttcttccccgcgacgcaaagcggcctgtcggatccgttcgcgccggacgacgcgaagaatgccgcaccaccgaaggacggcgaaatcgccggcgccagcacgaatggcccgctgcccgtgctgaacgagcagtcgccgggccgctggcagaagatcccgctacggccgggcgcggtgcagaatttcaaatgggagttcagcgccgtgcacaagacgcgtcgctggaactacttcattacacgcgccgactggaacccgtcggaaaagctcacgcgcgcgcagttcgagcccacgccgttctgcacgatccagaatcccggccagccatactggaacccgaacgcgaacctggtgccccagcagccgaccattcacgcgtgccggctgccgatgcgtagcggctaccacgtcatccttgcagtctgggaagtcgcggatacggcgatggcgttctatcaggtcgtcgacgcgatcttcaccaatggcgatacgacacgcagcccgttctgatacggtcgcgacatgacgcgcccggcgacgcccggcgcgtcatgagttgaagaacccgtgtgaggggcactgacacggcaaccggcttacccggcgaccacctggttgcggccttgatgtttcgcgcggtacaggcgttcgtcggccttgcgcaggatcgcgtcgatcgtctcgccgtcccggccgaattcggaggcgccgacactcacggtgaccttgatcggttcgccgatgcctgcttcgaacggcgcgccggcgattgccgcgcggatgcgctcgccgatcgaccgggccgtgtccagtgcggcttgcggcagcagcaccatgaattcctcgccgcctacccgcgcgacgccatcgtacggccggatcgcatcggtgcatttgtcgacgaagcgttgcaacacctgatcgcccgcctgatgcccgtaactgtcgttgatcgccttgaagtggtcgagatcgagcgcgagcagcgagaacggcgcgccgttgcgcttggcccggttgatttccgcttccacgctttcgatgaattgccgccggttggtcgcgcccgtgagcgggtccgtggccgccaggtgctcgagttttcgttggtccgttgcagcgcctgcaacgcgcgctccgtcctggccatcgcgtccctcaaccgggcaaacagttctgcctggctgtagatcttcgaaaacgaacgggtcgtttgaaaggcctgcaccacgccgaaactgagcaggaagaagccggctgcgaaaatcgcatgcgcgagccaccacatgtgattccacggccgcccgaggatgaaggcgagcgacgagagtgcgaacgacgtgaccgaaatgccgtagatcgtcatcagcggcgagcggatgcggcgtacgaccagcgcaacgacgttcacggccgagagcagcagtgcgccgccttccatcgacaggcgcacccacaggtggccggctaccggcgagaaggcgatcacggcgaccgcgacgtcgacgagtccgaacagcgcgagccagggcaaccagatgcggggatcggcgcgggtcgttgcgctgtcggccttgtgactataggtgagctgcccgacaaggatcaggatcgacatggtcaggcgcgatgccggcccgtacagcaggaacagccagatgttgtgatgcgccatgccggtgaacaggccgtgcaacgcatagatgacggaaaagcccagaaagcccagcgtaagccagcgaagcaacggctcacccgacaggcgatagcagcgccagcagacatacgtgacgaacgcgccttcgagcgtggcggccgcgatcgccagctcgtgaaaggcgtgattctcgaatttcagcgacgggtcctggaagaagtacaggtaggcgatcagataggcgggcagcagcgcgaagccgaccagcaggagcctcgcgtacacccgggtgaccagttgggcggtgcgggtcgacgcttgggggcgagatcgacagtcatgttcggcctccgggttcggtggatgcatcaaggacggctacgtgacgtcatcgcgggtcggcagccaatacgatgaagcccgatcgcgtcgcctgaatttcgttgatttgaacaatcagccaaatggctgcgggatatccggttaaattatcgaatggcgataattgcaatatggcaatgcgatcgcgtgaatatttctgatttcgatatgggtgaaaatactcgattcaagggttgatgtctgacgattatgtagtataaccaaacgaaacgtggacgtcggattgaagcatcactacattgaccggcaaaggccggtatccgccgccgcttggcaggcacggctatcccaagcctgcgtgacggcttcacgtaccgcctgcatcgcgcttgtgacggacatccggccctgcgcgaaagtggcgtacacatgcttcaccagcatagaccgaagttgtcgtttttccgtcgtagatataaaaacagaatcaatatagaaattcgtcttcaggtggcaatttgtaaggttgatttttgtgaattcgaccttggcggagctttgtcgatcgaaaggagaagccaccgggtggaggagccgcaaggctgatctgatcacgatgttgattttatagtccgtatcaatgatgccgacgcttgccgtccgcgtgacgtggcgggtttccgttacgcctgcgtgggcggagcgcgtcttcctgaaatattcccggcatgtatcgcgtgaaagaccgatgccggcaatgcgtaaaacgcgatgagggcgtgaaaatgaagagcaaccgatccggaatcatgcagcgatcaaccttgaaaggcgcgctggcgcttctgttggcatggtcgtccttcggcactggcactggcaccggcaccgccgcggcagccgggacgggtaccggcacggcgccggcattcgtttatagcccgtacaaggacgcgacgatttcgatgaactggaacacgaacgtcatctcgtcgaacgtcaccggtcagatgagcccggtgctgtcggtgctgccagccggtgtccgtacgctgacgctcgcgtttgcgaccggcgaatgcggcagcgagaactgggcgggcgtcgacggcggcgcgatggcggccgccaatgtgccgctttcaccgcggccaatgtgaattacgtgatttccaccggcggcgcggccggcatgttcacgtgcgggtcggatgcgggcatggcggccttcatcaatcgttatgcatcgaacaacctcatcgggatcgacttcgatatcgagggcgggcagacacaacaggtgatcgacgatctcgtccggcgcgtggcggtcgcccagcagaattatcccggcctgcgcttcagctttacgctcgcgacactggccccttcccagcagggcgcgaccacggccggctcctggggcgccagcgccccgacagcttcaacgtgtacggagactgggtcatgcaggcgatccaggcgcacggcctgaagaactacaccatcgacctgatgacgatggactacgggtcagcgggggcggggaactgcgtggtcgcgaacggcacgtgccagatgggacagtcggcgatccaggcggcgatgaacctgcacgatcactggggcgtgccgtacagccagatcgagctgacgccgatgatcggcggcaacgatgtgagcggcgaaacctttacgccggccgatgcggacaccgttgcgcagttcgtgaaacagaatggcctcgtgggtgtccacttctggtcgttcgaccgtgacgtcgattgtccgcccggcgccgcatcgtcgacgtgcaactccatcggcggcgtcggtacgctcggttatacgaaccggtttgccaacgacctcgcgcccggcaattgaacgaagcgggggcagcgcgccggatcggtgtcggctttcgcgtcgaccgtaccttcaggccgcggcggatcgccctttcggctcggcgaggtgtgccagcccgaggccctcgagcacctgcgcctgaatcgatgccgcttgggcgttgagggcgtcagcgccgaatgactcgcccacgatcaaacgcggcgggcgagtaccgttggcttgtgcgacaagctgcacgatcgcgtcggcgacgtcgtgcgggttcggcgcgtggtcgctcgcgaacagcgtcatgagggtctccaccatcttgtccggaatcgcaccggcctcgccgtagccgggtacgcgcgcggcgtcggcgggccgctgcgcactggcgaaaatattcgtcggatagttgctgggttgaacgagaacgacgtcgatgcccgacgtcgacaactcgtagcggtagctgtcggtcaacgcttcgagcgcgaacttcgatgcgccataaagaccgaagaacggaaacgtcacgcggccgagtatcgagccgatgttcacgatcaggccctcgccctgtttcctgaaggtcggcagcaccgccctcgacgttcgctggatgccgaatacattcacgtcgaagagcgcctgtacctgctgtgtcgtgaacgcctcggaaatacccgctgatccgatacctgcgttgttgacgaggacgtcgagatgcccggcattttccagcacggaagctacacctcgctcgacggacgcatcgtccgccacatccagttcgatgacgtgcatgcctttcgcttgaagggcatcggcatgcggccggtttcggccggcgatgtcgcgcatcgacgcgaatacccggtgcccggccgccgagagcccttctgcagtgtggcggccgaagccgctgctggcgccggttatcagaatagttttggtcatgtcgagtgtgttccagcaaaacaaggttggagagccgcaatcgaatcagcgcgagcatgtccggcgcggtcgagatgaaatggacgacgtcattggagaactcttcgccgcattgcagtgcagtctaggtttttcacggaaagcgggctatagtcgcaaatgacattaatggatgcgtttacgacatgagattgtccattctggcgctcgaagggctgttcgacaccggcctgacggtgcttttggataccttcgcgatggccaacgaactggctgccgcccagggctttgccgcgccgcccttcgacgtcggagtggtcggcgtacgcagacgcgtccgtaccgcgcacggactgtccatgctggcggagcccgcaagcagcgcacgccatgccgactgggtggtcgtgcccgcgcctggcatcaggcagccggagcgcctgatcgaggcgctggagcgtccggacgtgcgcgatgcaatggcgcaccttcgggcgtggcatgccgatggcgtcggcgtcgccgccgcttgcatcggtacgttcgtgctggcggaagccgggcttctggatcatcgccaggcgacgaccacctggtcgctctcgcccttctttcgtcaacgttatcctgcggtcgatctgaacgattcacgcatggtcgtcgccgcggatcgcctggtgacggcgggatcggccatgggccatctcgaccttgcgctgtggttgctgcgtcaggcgagtcccgaactggccacgctcgttgcccgtttcatgctgatcgacaagcgttcgtcgcaggccgaatacatcattccggattaccttgcccatgcggatccgctggtcgctcgattcgagcgatgggcccgcgagcatctttccacgggtttttcgcttcaggcggcggccgccgcattggccgtcggaccgcgcacgctgcagcgccgtaccgaggcggtacttgggaagtcgccattggcgttcgtccaggatctgcgcatcgaacgggcgcagaatctcgtgtcgatgggttacgacctggagacgattgcaagcgaggtcggctacgcggatgcggcgacgttgcgggccttgttgcgtcgcaggctcggccgtggggtgcgggaattgcgtgccagcaatcggtagcgtccggccccgaaaagcggcgtgccgtacgcggcgaatgccgagccgcggggccttgggcgccgccggaacggcactagcgcctgccggcgtgcccgtgaatacccgtcagttcgaccatgaaatccaggaacgcccgggtcttggccggcacgtgatgccgggatgggtagtacgcatataacggataccgctcgtcggcccattcgggaaagagattgatcaaccggccgtcggcgatcagcggctcggcaccgagcagcagcatctgcgcaatgccggaaccggcgaggcacgcgctgagcagggcgcccggatcgttgaccgtgaggcgccccgggtgtcgaccacgatgcgtttgcgccgacgatggaattcccaggcgaacggcttgcctgtctcagggttgcgaaattcaaggcatcggtggctccggttttcgaggtcctcgggtttggccggccgtccccggcgagcgatgtacgagggcgccgcgaccgtcacgacgccggtatcgagcagctttctcgcaatcaggctggatgatcgcggttcgccgaatcgcacggcgaggtcgaagccgtccatgacgaggtcgcccaggctgtctcgcgcgatgagctcgatttcgaggtcgggatgtgcgtccatgaacgcatcgagttgttgcccgagaatggcccggtaaacgacgggatccagattgattcgcagctttccgcgcacgacggaggcgccgcctgcggccgccgcggccgcttcctccagcccggcaagatgcggcatgacctgctcgtaaaacctgcggccctcttcggtcagcgacaccgaccgcgtcgttcgattgaaaagccggatgttcagctttctttccagtcgtgcaatcgctcgactgacgcccggcggcgtcatgcctattacgtcggccgcagccgcaaacgttccggcatcgaccacggcggcgaacacgctaatgctgccggacagtttctcgctactggatctcatggttgttcgagtgcatacggtggcggatcgcgggcgacccactgaaggccgctacgccgacgccggacagcgcagcaatgccggtcgtctgcgtcgatcatgccgaattagtgacgcgttgtcacttatctgcttccatccatgtcgttttgtttcgctcgatgtttggccagaatgcgaccgacgtattcacacacggagaacgaacatgtatgcgataacaggaatcaccggcaaggtcggcggcgcattggccagcgaactgctggcggcggggcggccggtgcgcgcggtcgcgcgcgacacgacgcgggcaggggcgtgggcggcgcgcgggtgcgagattgcgactgccttcatggaagacccatcgtcgctcgccgccgcgttcacgggcgctgcgggcgttttcatcctgccgccttcggagttcgatccggagcccgggtttcccgaggcgcggaaggtgatcgaggccgtgtccgcggcgcttctgatggcgcgccccgaaaaggtcgtttgcctgtcgacgatcggtgcacaggctgacgagcccaatctgctcacgcaacgcacgctgatggaacaggcgctgcgcgagatgccgatgcccgtgacgttcctgcggcccggctggttcatggagaacgccgcgtgggacgtcgcgtccgcgcgcgacgagggcgtcgtcgccagctacctgcagccgctcgacaagcccgtgccgatggtcgccaccgcggacgtaggtcgcgttgcggcagaactgctccagcagacctggcgcggtgtgcgtgtcgtcgagctcgaggcccgcgccgcgtgagccccgacgatcttgcactcgccttcgctcgcgttctgggccggcaggtgcgcgcggaaggcgtcgacaggcgaacgtgggaagcgctgttccgtgcgcagggcatgaaacatccactaccccgcatgcgcatgctggacggcttcaacgaaggctggatcgatttcgaaagtaatccggaagaaatcgtgcgcggtcacatcgcactggatacggttcttggcgagctggtgtcgcgtgcggtctgaatgaattcggtgggcggcgtgtggcgcgttggtgctacgcgccaacgatgcatcgtcgcagtcgaacgactgccggattccatgtcgattgtgtgtcgcgattgtcgctattaatgtcatttgtgactatggatcagacctcgtcgcgagtctagactgcgaagcgtttccggcatccgcagatctctgctgcaccttctgtacgacaaggccaatccgatgacattttcgccagaacttcacctgctgacgctcaccgcactcgcaacgctgctgatgtggattccgtacatgctggccaggatcatgacgcgtggcctgatggcggccctgaacaatcccgatccgtcccgtccgcccgatccgccgtgggcggaacgcgcacggagcgcgcatgcgaacgcgatcgagaatctcgccgtgttcgccccgctcgtgctgatgtgcgcaatgacggggcgagcagcccggcgacggtgttcgcggccaagctctatctcggtgcccggttggtgcactacgtggtctacgccgccggcattcccgttgttcgcacgatcgccttcctggccggcttcgcggcgacgctcacgttcgctgttgcgttgctcggacacgcgagctgaccccacgcacttgcgtttcacttgcctgcttacttcagaggtcaccatgaaatcgactcccggcaacatcctcgacacgatcggcaacacgtcactcgtcccgttgcgaaacgttgtcccgaagaacggcgcacgccttttcgtcaagctcgaaagccagaatccaaccggcagcatgaaagatcggatcgcgctcgagatgatcgaagctcccgagcgggatgggcgtctgaagcccggcggcgcagtggtcgaatacaccggcggcagcacaggtgtgtcgctggcgctggtgtgtgccgtcaagcggcatccgctgcatctggtttcatcggatgcgttctcgaaggaaaagctggatcacatgcgcctgctgggcgcgaagctgacgctcgtcgccagcgacaacggcaagcaaaccgagaagctgacgaaggacatgattcgcgaagcgcatcgaattgccggcgagacgggcgcatacatcacggcgcagatggaaaacaccgatcagctcaacgcctatacgaagatggccgacgagatctgggagcagaccggcggccgcctcgacggcttcgtccagagcgtcggcacggctgcgtcgctgcgcgggatctcgcggcgcttgcgcgaacacgatgcacgcattcggatcgccggtgtggagccggccgaatccgcggtactgtcgggcggccctaccggcgcgcacaagatcgacgggatcggcgcgggttatgtcgtgccgctttggcgcgacgggattgctgacgagctcgagcgtgtctccacggaggaggcgagagccatggcgttccgactggccgccgaagaggggttgttctgcggtacgtcgaccggagccaacgtaactggcgcattgcgactcgccgaacggcttggcccggacgccacgatcgtgacgatcatgtgcgacaccggcatgaagtacctgaagtcgttcgcgccaacgacgggctgacggccattggtcgtagtcgcatcgttttgcaccaagaccggtttcgtctggcgcagcaggtgaacggcgatcagcacggccggcacgacgccgatgatccggtggcgggcatggcgccgtgctggcgggaaggcctcgggttcactcacgtcggcctcacgcacggatgatgcatcgctctactggatgacatgaaaggattcctgataataaagcggtggagcgaatgaaaagggacggcgtctgcgacgcggccgtccaccgttgatcgacaaccgaccggtgccgcatcgggatgcgcgagcgtgtgcgacggcggacagtcgttacggttggtcggcagcggtgtgtcggcttcggcatcgatcggttgctggcggacttcggtgcgcgtgagcgacgccagcgtggatggcgcgaaagtctgcgtgccgaacggcagggtcggtgcctgttatgaaccaatagagatccagccattggcggatttgacccgtgacatattcagggtgacgcgcaggtgacgtttgtttcaccgcgcggttcttgtcggggctattggagccattttgatcatcgtgacccgattaagcgattaagaacacgtaattgaatcaatcgcgcggaaagttacgctttaattttcagcatgaaaaatgtgtgattgagtaacattggttgcgtctatttttaatctcaggtgggcattttcagacgcagcataattcggatcggcgacgtacaattcgctgcgaaacggtaatgccgtgaaaaacgcgccattttcccaaagcccctcgaacccggctggttttctcttgatcgccattggcatggttgccgggcaccgctggcgcctgttgtgaacaccgacagcggcccgaatgcagaatgacccacaacagatacgacagctcgccccgacgcatggcgaccgtcatcgacaccaaggaagcaagatgccgacattccaggtgatgttgaagatggcactctacgtttcgctggtcctggccacgccaggcccgacaaataccttgttgctgtcctcgggaatcaaggtcggcttccggcaatcgtcgcgactcctggtggcggaggcatcgggctacggcttcgcgatatcactgtggggcttcttcctggcgaccttcgcggccacgcggccctggctttacgatgtgctgaagctggggagttcggcctacatcttctatctcgccctgcagctatggaaaagcccgcatcttgagggcatccggtcgggcaccatcggctttcgcgacatgttcgtcgcgacgaccatgaatccgaaggcgttgttgttcgccacggcgatctttccccgcaggctttcgtatcggttccgttctatctctgctcgatcgcggtttttacggcgcttgccgtgacgatcggttcgatgtggcttgtcgtcggcggtgtcctgacggcgcgccggtcgctggccacccataccggaacgctgcttcgcggcgcgtcggtcgtgctggcgatgttcgcgggcacgctggcgttttccgtactcaatcgctaaggcctgtcgggcagcaccctctcatcgccgcgagcaggtcaagttcgccgaaatgcgcaagggtcgacatcattgtttcgcaaatggtgtcgaccttattcgttcccgttaattgggtagttcatttatcgtttttatacaataaataggtgtgttgtctaaaaatgaaatggttgatttttaaaatgtaaatgctcatccataaaatatctcgccaatattttatggattgaatatttctctggagcaatgaaaattgatatgaaattttacgaggtatgccgtcgtgaacgctgttaaggtgtatcggacaggttacgcgaacggtatggaaagcttcgggaggctgaagtctcatgtgtattcgatgcgttaatggcaatttccgcatcggcaagccaatccattcatgacgcgttaccggacgatttacgagttcagctcgatcaggcggcaccatcccttcaggtttcaaatcctatgagaaccgtgtcatgagcaacccgatcaagaatatcgtcatcgtgggcggcggcaccgcgggctggatggccgcttcgtacctcgtccgggcgctccagcagcacacgagcattacgctcgtcgagtccgcagcgatccccggatcggcgtgggcgaggcgaccatcccgagtttgcagaaggtgttcttcgacttcctcgggataccggagcgggagtggatgccccaggtgaacggcgcgttcaaggccgccatcaagttcgtgaactggaggaagtcccggagcgctcgcgcgacgatcacttctaccacttgttcggcaccgtgccgaactgcgacggcgtaccgcttacccactactggatgcgcaagcgcgaacagggcttccagcagccgatggagtacgcgtgctacccgcagcccggggcgctcgacgccaagctcgcaccgtgcctgtccgacggcacccgccagatgtcccacgcgtggcacttcgatgcgcacctggtagccgacttcctgaagcgctgggccatcgagcgcggggtgaaacaggtgatcgacgaggtcgagcaggttcacctgaacgaacgcggctacatcgccagcctgtccaccaaggaagggcgcacgctggaggctgacctgttcatcgactgctccggcatgcgggggctgctgatcaaccaggcgctgaaagagcccttcatcgacatgtccgactacctgctgtgcgacagcgcggtcgccagcgccgtgccgaacgccgatgcgcgcgtgggagtcgagccgtacacctcggcgatcgccatgaatgcggggtggacctggaagattccgatgctgggccggttcggcagcggctacgtcttctcgagcaagttcacgtcgcgcgaccaggccaccgccgacttcctcaacctctggggcctgtcggacaagcagccgctcaaccagatcaagttccgggtcgggcgcaacgggcgggcgtgggtcaacaactgcgtcgcgatcgggctgtcgtcgtgcttcctggagccgctggaatcgacgggaatctacttcatctacgcggcgctttatcagctcgtgaagcacttccccgatacctcgttcgacccgcggctggcggacgcattcaacgccgagatcgtccacatgttcgacgactgccgggatttcgttcaggcgcactatttcacctcgtcgcgcgacgacacgccgttctggctcgcgaaccggcacgacctgcgcctctcggacgccatcaaggaaaaggttcagcgctacaaggcaggattgccgctgaccaccacgtcgttcgacgattccacgtattacgaaacgttcgactacgaattcaggaacttctggttgaacggaaactactactgcatctttgcgggcttggggctactgcccgaccggtcgctgccgctcttgcagcaccggccggagtcgatcgacaaggccgaggcgatgttcgcccgcatccggcgcgaggccgagcgtctgcggacgagcctgccgacgaactacgactacctgcggtcgctgcgcgacggcggcgcggggttgtctcgcagccagcccgggtcgacgctcgcggcgccggaaatcctgtagtggagcgcaccctggaccgcgcatgcgcattcgcggcgacgcacgccgcggtggcggcttgcgatccgctgcgggcgcgggcgctcgttctgcaactgccgggcctgaaccgtcagaaggacgtgcccggcatcgtcggcctgttgcgcgagttcctcccggtgcgcggcgtgcccgccggctggggcttcgtcgaagccgccgccgcgatgcgggacatcgggttcttcctgggctcgctcaagcggcacggccacgagcccgtggacgcggtgcccgggctcgagccggtgctgctcgacctggcgcgcgtgaccggcctgccgccgcgcgagacgctcctgcacgtgacggtctggaatcccgcggcggccgacgcgcagcggagctacaccgggctgcgcgacgaagcgcacctgctcgagagcgtgcgcatctcgatggcggccctcgaggcggccatcgggatgaccgtcgagctgtacgacgtgcccctgcggtcgccgtcgttcgccgaagggtgcgacgagctggcggactatctccacaagatggtcgaatcgatcgtttacgcctaccgctatatctcggtgcaggtcttctacgacgagcttcggccgtactacgaaccgattcgggtcgggggccggagctacctcggccccggtgcggtggaaatgccgctcttcgtgctggagcacgtgctgtggggtcgcaatccgaccacccgggttatcgggaattcaaggagacgtacctgccgtacgtgcttcccgcgttcggggcgatctacgcgcggttcgccggggcgccttcgctcgtcgaccgcgtgctcgacgaggtgcaggcgacgggcgcgcgggcgagcccgtcgtggccgggctggccgccctcgaccgggtcttcgagatcctgctgcgcttccgcgcgccgcacgtcaaattggcggaacgggcgtacgaagtcgggcgaagcggcccgacgatcggcagcgggggtacgcgcccagcatgctcggcgatctgctcacgctcacgcgtgccgtgcggtcccgccttcgcgccgcgctcgacgagccctgacacccgacgcccgacgcgtgcggccatgtgtttcatctcacaaggagagtgtgccctcatgactcaaaagagccccgcgaacgggcgcgacagcaaccacttcgacgtgatcatcctcgggtcgggcatgtccggcacccagatgggcgcgatcctggccaaccagcagtttcgcgtgctgatcatcgaggagtcgtcgcacccgcgcttcacgatcggcgaatcgtcgatccccgagacgtccctgatgaatcgcatcatcgccgatcgctacggcattccggagctcgaccgcatcacgtcgttctacgcgacgcagcgttacgtcgcatcgagcacgggcatcaagcgcaacttcggcttcgtgttccacaagcccggccaggagcacgacccgaaggaattcacgcagtgcgtgattcccgagttgccgtggggcccggagagtcattattaccggcaagacgtcgacgcctacctgttgcaggccgcgatcaaatacggctgcacggtgcgccagaagacgaacgtgaccgaataccacgccgacaaggacggcgtcgcggtgaccaccgcccagggcgaacggttcaccggccggtacatgatcgattgcggcgggccgcgcgcgccgctcgcgaccaagttcaagctccgcgaagagccgtgccgcttcaagacgcactcgcgcagcatttacacacacatgctcggggtcaagccgttcgacgacatcttcaaggtcaaggggcagcgctggcgctggcacgagggaaccctgcatcacatgttcgcgggcggctggctctgggtgattccgttcaacaaccacccgcgatcgaccaacaacctggtgagcgtcggcctgcagctcgacccgcgtgtctacccgaaaacggacatctccgcgcagcaggaattcgacgagttcctcgcgcggttcccgagcatcgcggcgcagttccgggacgccgtgccggtgcgcgactgggtcaagaccgaccgcctgcaattctcgtcgagcgcctgcgtcggcgaccgctactgcctgatgctgcatgcgaacgggttcatcgacccgctgttctcccggggctcgagaacaccgcggtgacgatccatgcgctcgcggcgcgcctcatcaaggcgctgcgcgacgacgacttctccccgagcgcttcgagtacatcgagcgcctgcagcagaagctcctggaccacaacgacgacttcgtcagttgctgctacacggcgttctcggacttccgcctgtgggacgcgttccaccggctgtgggcggtcggcacgatcctcgggcagttccggctcgtgcaggcccacgcgaggttccgcgcgtcgcgtgacgagggcgacctcgatcacctcgacaacgaccctccatacctcggatacctgtgcgcggacatggagggtactaccagttgttcaacgacgccaaagccgaggtcgaggccgtgagcgccgggcgcaaggaggccgggaggccgcggcgcggattcacgccctcatcgacgaacgcgagttcgccaggccgatgttcggcttcgggtactgcatcaccggggccaggccgcaactcaacaactcgaagtacagcctggtgcccgcgatgaagctgatgcactggacgcaaaccagcgcgccggcagaggtgaaacggtacttcgactacaacccgatgttcgcgctgctcaaggcgtacatcacgacccgcatcggcctggcgctgaagtagccggcccacaccgccaggaaaacgatgaacgacgttcaattcgatcaagcggtcgccacggagcaagccccggggtgtacgacgcgaccacgcgcgtggccgcgagctggtacgtcgcgatgcgctcggacgacctcaaggacaagccgacggagttgacgctgttcggccgtccgtgcgtggcgtggcgcggcgcgaccgggcgggcggtggtgatggaccgccactgctcgcacctcggcgcgaacctggccgacgggcgggtcacggacgggtgcatccagtgcccgtttcaccactggcggtacgacgagcagggccggtgcgttcacatccccggacacagccaggtggtgcggcagctggagcccgttccgcgcggcgcgcgtcagccgacgtgggtcaccgcggagcggtacggctacgtgtgggtctggtacggctccccgcagccgctgcacccgctgcccgaaatcgccgcggccgacgtcgacaacggcgacttcatgcacctgcacttcgcgttcgagacgacgacggcggtcttgcggatcgtcgagaacttctacgacgcgcagcacgcgaccccgtgcacgcgctcccgatctcggccttcgaactcaagctgttcgacgactggcgcccgtggccggaggtcgagccgctggcccgggcgggcgcgtggttcggtgccgggatcgacttcaccgtgaaccggtacttcgggcccctcggcatgctgtcgcgcgcgctcggcctgaacatgtcgcagatgaacctgcacttcgacggctaccccggcgggtgcgtgatgaccgtcgcgctggacggagacttcaaatacaagctgctccagtgcgtgacgccggtgagcgacggcaaaaacgtcatgcacatgctcatctcgatcaagaaggtgggcggcgtcttgcgccgcgcgaccgactacgtgctgttcgggttgcagacccgacaggccgcgggtacgacgtcaggatctggaacgggatgaagccggacggcggcggcgcgtacagcaggtacgacaagctcgtgcttaagtaccgcgcgttctaccggggctgggtcgaccgcgtcgccgagacgggcgctcgaccgcaccgccgcgagtgagcggcgaagcgtgaggcggcggccgggagccggccaatgagcaggatcgcgccggaaaggcatgcggccggcatgcccgagccgagcacggcccgtttttcgcgatcatcgtttcacgtcgtcggacaggcgggcggccgtcgggccggtgcgctcgagcgcttgagcgacaaggatttcgcgggcccggctgcgggcgccgcgaaatccgccgacaggtgccgggtcggcgcgcgatccggctgcccaccggctgccgaacagatgcggcgatcaagagccggccgatgccgtcgcgaccggcgccgcatcgggatgcgcgcgcgcgtaaagctggcgattgcgcgcgatctgcgcctgcgacggtgggtagtcgttccggtccgtcggcagcaggccgccggcttcggcattgatcagctgctggtagatttcggcgcgcgtgagcggcgcctgcgtggactgggcgaaggcctgtgtaccgaacggcaggctcagcgcggcaacgacaaaggcagtgaagagtttcatggcgattccctggtggttgaacgaacgggcgagtggggcggccccacgtatcccattctggttgccgcggcagtcacgacgctgacccgccgattacagttttgtaatccgcccgtttcgcgcttgcacgatgcggctcgcgcgccgcgtttcccggtaacatcggcgcatgtcaccaccccatgcgacggagccgaccatgcgcatcctgatagtcgaagacgaaccgaagaccggcgcgtacctgaagaaagggctcgaggaatccggcttcagcgtcgatctcgcgaaggatggcggcgagggcctgacgctcgcgcaggaggaaagctacgacgtgatcgtgctcgacgtgatgctgcccgtgctcgacggctggagtgtgctcaagcggctgcgcgacacgcacgcgacgcccgtgctgttcctgaccgcgcgcgacgacgtgcaggatcgtgtgcacggcctcgaactcggcgccgacgactacctcgtgaagccgttcgcattcgtcgagctgcttgcgcggatccgcacgctcgcacggcgcgggccgccgcgcgagacggagcgcatcgcggtgggcgacctggagatcgacgtcgtgcgccgccgcgtgaagcgcggcaccgtgcggatcgacctgacgccgcgtgaattctcgctgctgcaactgctcgcgcgccggcagggcgaggtgctgagtcgcacgcagatcgcgtcgtacgtgtgggacatgaatttcgacagcgacaccaacgtcgtcgaagtcgcgatccggcggctgcgcgcgaagatcgacgacgatttcgcggtcaagctgattcatacggtgcgcggcgtcggctacgtgctcgagccaaaggacgccgcatgacgctcggccgcttgatcggccgctcgatcggagcgacgctcgcgctcgcgttcggcgcgaccatgctcgccgtcttcgcgcttgtcggcacctatgtggccggccctcgagcggcaggtgagcacgcaggacgacctcgacatcgtgctcgccgcgcggcacacgcgccggctggcgggcgagctcgattcgctcgacgcggtgcgcacgcatgcggaccggctgacgagccaggtgcttggcaacgcagcgctgtcgatcgccgtcgtcgacgggcagggcaacgtgctcgcgcgccacaacgtcgagcgcaccgggttcgaggactcgcccgagccggcggcagccgcatcgacgcccacctcgcccacctcgcccgcgctgccggcattgcccgacgccgcgctgttcccgccgcacgcgacgccggtgcccgcgaacgaacggatcaccaccgaccggatcgcgacctggacggccgccggcggcgtgtccgtgcgcggcgtcgtcagcgacgcgcagttgcgcgaccactcgacgatccggatcgcgatcgcgcgcaacatgagcgatcgcgccgcgatgctcgacggctaccgcgaccggctgaagatcgccggcggcctgggtgcgctgttcgcgatgctgctcagctactggctgatccgcacatcgctcgcgccgctgcgcgagatcgtcgcgaacacgggccggatcaccgtcgacaagctcgatacgcggctcgacgcgtcgcgtgcgccgcgcgagctgacggcgctcgtcgacgcgcagaacgcgatgctcggccgcctgcagcaggcgttcggacacctgtcgcaattcagcgcggatctcgcgcacgacctgcgtacgccgctgaacaacatgcgcggcgcgaccgaggtggcgctcgcgcgaccgcgttcgcccgacgagtaccaggcgctgctcgaatcgaatctcgaggaatacgaccgtctcgcgcggatgatcgagaacgtgctgtttctcgcgcgcgccgagcatccgggtttcgtcacgcggcagcgtgcgttcgacgtgcatgacgaactggagcgtatcgccggttatttcgaagggctggccgacgaagcgggatcgacgctgcgcgtcgacgggcatgggcaactgaccgccgatctcgaactgttccgccgcgcggtcagcaacctgctggccaatgcgctgcgttatacgccggcgggcggcgtgatcgcgatgagcgtcgacgaaacggcggatgcggtgcgcgtcgtcgtcgcgaacccgggcgagccgatcgatcccgcgctgctgccgcgcatcttcgagcgtttcgtgcgcggcgaccccgcgcgcagcggcggcgtgccgggcggcacggccgggctcggcctcgcgatcgtgcggtcggtgatggaattgcacggcggcaccgcacgcgtcgaaagcgacgcggccggcacgcgcttcatcctcacgttcgtcaggatgccgacggcgtagcggccgcgtgcgcggcggccgttgcgtgcgcatccatatccgtatccttgttccagccgccgccgagcgccgtcagcagcgcgaccgccgcctccatccggcgcgcggcgatctggtcggccaggcgccggtttgacagcgcgatcgtctgcgcggtcacgacgtcgagatagctgaccgcaccggcgttgaagcggttggtcgtcagcttcagcgacaggtcggccgcgtcggtcgcgcgctgctggctgttcgcttccgatgcgagcgcatcgagcgcggaaagctgatcctcgacctgctggaacgcggccagcacggtttgccggtaatcggcgaccacgccgtcgtactgcgcatgcgcggcttgcagcgacgcgctgcggcgcccgccgtcgaacagcgtgccggcgagctgcgagccgagcgaccagaacaggctcggcgcggtgagccacggcgcgaagaacgaactttcgagccccgcgctcgccgacagcaccaggtcgggaaagaacgcggcgcgcgcctcgccgatctgcgcgttcgcggccgcgacgcgccgctcggccgccgcgatgtcgggccgccgctcgagcagttgcgacggtacgccggccgggatcgccggcacgtcgaatgcctgcacgcgcggcggcagcgtgaaggtcgacgcgctttcgccgaccagcgtcgcgagcgcatgctgaagttgcgcgcgcgacgcgtcgatgtcggtgtcctgcgtctgcgtcgattcgagctgcgtctcggcttgcgcgacggccgacgcgtcgatcgcgccgtccgcgagttgctgcttcagcagcttcagtgcatcggcatacgcgcgcaccgtttcgtcgagcagttgcttctgcgtgtcgagcgagcgcagcgcgaaatagtcggtcgcgagctcggccgtgacggacagtctcacggcctgcaggtcggccgcgctcgcgtcggcattcgcctgcgcgcccgtcacggcgtcgcgcacgcggccgaacaggtcgggttcccagctcgcggcgacgccggcctggtagtcgggcgtcgtcttgccggcgagcgacgagccgagcttgttctgcgacaagcgcgagcggctttgcgcgacgccggccgtgacggtcggcaggaaccccgcacgctggtagccgaccatcgcgcgcgcctgctggagatcggcgacggctttcttcacggtctggttcgagatgtcgacgcgcgcttcgagcgcgttcagtgcggcgtcgtcgaagacggtccaccacgggccgcgcgacgcggcatcggcgggcgtggcgacgttccagccgggttgggagacggggcggccgaagccggtacgcccgaagccggtatgcccgtagccggtacgcccgcatagtgcgcaggcaccgcgacggtgggggcgagtaggcgggtagcgtcgagcatgcggtcaacgcggcggcgatgccgagcgcgacgacgcggcgcgcgagcgggagcggatgaaagaggcacatggtggagatctcgcgggttgtcatgaacggtcagctgcgggccttcgtcgacgtcgcaaccggcgtcgacgcgggcgccgcgacggcggccggcgctgccgcggccgctaccgcgcgaggcgccgccggcacaccggtagccgagccggcccgcgcagccgcctgcgccgcgccgggctcgaccgccacgatcttcacggtctcgccgtcggcgatcgaatcgcccgggttgtcgatcacccgatcggtcgcggccagccccgcgacgatctcgacgtgcgtgccgaaatcgcggccgatttgcacggtcttcagcgcggtggtgccgttcgcggcgacggtcgcgaccgtcacgccgttcggccggaacagcagcgcgctgaccggcagctcgaacgcgggcgccgcactcgcgacgagcaggtgcgcctgcgcgtacgcgcccggcatcagcgcgccgtcgtggttgtcgacgtcgatctcgacccgcagcgtgcgcgtcacgggatcgatcgcgcccgcgctgcgcgccacgcgcgcggcgaagtgccggcccggatactgctgcgtggtcaggtacacgggcgtgccggccgacacgccggtcgcgctgtcctgcggaacgtcgacgaacacgcgcagcgtgtcggtctgctcgaggtggaacagctcgcccgacagcccgggctgcccggcgtgccgcccgccgtgacgagcgtgccgacgtcgacgttgcgcgcggtgatcacgccgtcgaacggcgccgtcaccgattcgtacgacacgagttcgttcagatgggcggcattcgcctgcgcggaggcgagcatcgcgcgcttcgcgttcatgtcggcgaccttcgtgtcggtgtcctgctgcgataccgactgcgtcttcagcatctcctgccagcgctgcgcggtcgatttcgcgtagtcgtagttcgcctgcgcggtcgacgtgtcggcgtgcgcctggcgcaactgcgcgtcgaggtcgggtgccgtgatctgcgcgagcgtctgcccggctttcacgtgcgtaccgatatccgcgctccagtgcgcgatataaccgctcgtgcgcgcgtagatcgacgcttccgcgtagggcatcaccgcacccggcagcgtgagcgtctggtcggccggcgcggcgccgggccggatcacggacaccggcagcgcctgctgcgcggccacctgcacgcgctgcgcggcgcgcgcatcgatacgcggcacgatgccggcggccagcagcgcggcggcgaatgcgagcgcggccagcgggacggcgagccggcggccgcgacggggcagcggcgcgtcgggtgcggtgtcgcgcgcgacaggcggcaccgccgccgtttcggcggaaagcggggcgagaggttcggtcgagtcgttcatgatgggttcgaagtcgggcgagtcggaggaaatcggcgggtatccagtccagctatccgggtatccgtgctcaaggcagtgccggcgtgtccggcacgcggcgtgcggcggccgcatcgcgtcgccgttcgagccacgcatggacgaagccgaatacgacgggtacgaacagcagcgtcgacaccgtgccgaacgcgaggccgccgatcaccgcgcggccgagcggcgcgttctgttcgccgccgtcgccgaggccgagcgccatcggcagcatgccgatcagcatcgcgagcgcggtcatcacgaccgggcggaaccggctgaaccccgcgtcgagcgcggcctgccacggcggcgtgccgccggcgctcagctcgcgcgccgcgttgacgacgagaatgctgttcgcggtcgcgatgccgatgcacaggatcgtgccggtcagcgcaggcaccgacaacgtcgtgttcgtgacgaacagcatccacgcgatgcccgcgagcgacgcgggcaggccgctgacgatcacgagcgggtcgagccacgactggaagttcacgaccatcagcaggtagaccagcgcgatcgcgagcacgaggccgctcagcagccccgcgaacgactggtgcattgcctgcacctggccgcgcagcacgatcgacgagccgggcggcagttgcgcgcgtgcggcgtcgacgagcttcgtcacgtcggccgtcacgccgccgagatcgcggtcctgcaccgacgcgaagatgtcgagcaccggctgcacgttgtagtgcgacacgacggcctgctgctcggcgcgcgagaaggtgcccagcgtgccgagcaggttctgcgcgcccgcgccggccgcggggccgcccgcgggcgtctgcggcgattgcgcggcggtcggcatcgcgatgttcgcgagcgactgcagcgaattgacgtcgtactgcggcgtttgcaccagcaccgggtaactgacgccgttggcggggttcagccagaagttcggcgtggtctgcgagctgccggacagcgcgatcagcaggttctgcgccacgtcgcgctgctggagcccggcctggatcgccttggtgcgatcgacgtcgacgttgattgcgggtgcgtcgccgggctgctggatgcgtgcgtccacgaggccgcgcacgccgcgcagttgcgcgagcagccggttcgcgaccgcgcggttcgcatcgagccggttgccgacgatctggatgtcgatcggcgcgggcaacccgaagttgaggatctggctgacgatgtcggccggcaggaacgcgaaggtcacgcccgggaacgcctggttcagcaggttgcgcagcttcgtcacgtactgcgcggtcggccggtggttcggcttcagcgtgatcatgatgtcggcatcgccggcgccgaccgggtcggacgagtcgtaggtcaggttgatcccgctgaccggcacgccgatgttgtcgagcacgccggcgagttcgttcgcggggatcaccgagcggatccgcgtctcgacctcgtcggtcaggcgcgcggtctcctcgatccgcgtgccggtcggcgcgcgcaggtgcagccggatctcgccggtatcgaccgacgggaagaaatcctgcccggcgacggcgaacaggctcgtggaagccacgcaggcgagcaggaacgcggccgcgaagcggcgccggttcgcgatcgcggccgacagcagcgcgcgatagcgcgcgcggaccgcttcgaaacggtgctcgaaggcggcctggaagcgcgcgaagcgagcgaagatgccgcgcggcggcttgccgtgccccttggcgcgcatcagcaccatcgcgagcgtcgggatcagcgtgcgcgagaagaagtacgacgcgatcatcgcgaagatcaccgcttcggccatcggcacgaacaggtagcgcgcgacgcccgtcagcaggaacatcggcgcgaacacgatgcagatcgacagcgtcgacacgaaggtcggcacggcgatctcgcccgcgccggtcaggatcgcctcctcgagcggcgcgccgcgttcgaggtggtgggtgatgttctcgatcgcgacggtcgcatcgtcgacgagaatcccgaccgcgagcgcgagcccgccgagcgtcatgatgttgatcgtctcgccgagcgcggccagcgcgcacagcgacgtcagcaccgcgagcgggatcgtcacggcgatgatcagcgtcgcgcgccagctgccgaggaacagcaggatcatcagcgccgtcaggcacgcggcgatcagcgcttcgcgcgcgacgccctggatcgccgctttcacgaacaccgactggtcgccgagcggcgtgatgtgcagcgccttcggcaggccggccgcgatcttcggcagcatcgccttcacctggccgatgatcgtcagcgtcgatgcgctgccggtcttctcgaccgtcagcagcgccgcgcgcttgccgtcgctgcgcacgatgttggtctgcggcgcgtagccgttgcgcacgtgggccacgtcgcgcacatagacgacgttgccgccgatggtcttcaccggcaggtcgttcagcgcggcgacggtctgcgtactgccgttcatctgcacgttgtattcgcgcgcgccgatcttcgcggtgccgccgggcaggatcaggttctgcgcgttgatcgcgttgaccacgtcgatcggcgcgagccccttggcctgcagcgcgcatgttcaggtcgacgacgatctcgggcaccttgccgccgaacggcagcggcacggccgcgccctggacggtcgcgagctgcgtgcggatgaagctgttgccgaggtcgtacagctgctgctcggcgagcgtgctgctcgacagcccgagctgcaggatcggcaccgtcgacgcgttgtacgtgatgatgttcggcggcagcgtgcccggcggcaggatccgcaggatcgacgcggagttgctggaggcttcggcaatcgcgcgattgatgtccgcgccggggtggaagaagatcttcacgaccgacacgccgttcagcgattgcgattcgatgtgctcgatgtcgtcgacgtcggacgtgagcgcgcgctcgtagttggtcgtgatgcgcttggccatgtcctcggcggaaaagccgttgtacgaccagacgatgctgacgaccgggatgtcgatgttcggaaagatgtcggtcggcgtgcgcaggatcgcgagcgtgcccgcgatgaagatcagcagtgcgagcacgacgaacgtatagggcctgcgtaacgccagccggacgatccacatgatgttttcctcgaagcagagcaagggcgccgcgatggatgcgacgagcgtgcagtctgccggtgccgcgttgacccggccctgactcgaagattacgaaactgttatctgcgcgtggcgccgcagatttcaggattgtcatgtaacggtcagcgtcgtgccggccgcagtcaccagaatgaagacgtcgggcggagaaccgcatccgcggcaccgccggcggcgcatcgacgatgcgtcctcatctaaccgttctgggagtttcatcatgaatcgcagactgatcgcagcgaccgcgctgctcgccctcgccatcggcacgccggtagccgctttcgcgcaagcgtcgtcgtcgggcccgacccgtgccgacgtgatcgccgagctcgttcaggcgcagcgcgacggcaccgtgcccatgtcgaactgggactatccgccgagcccgcagacgatcgcgcgcaatcgcgagctttatgcgatcgcgcacggcgagcaggccaccgcgaccgcgtcgacgccggtgccggccgtcagcgcgcagtgaccgggagacaggcgatgaagcgcctttcccggctggcgatcgccgcgctgctcgcggcggcggtcgcgccggcctttgcacgcgggatgtcgcaattgcccgatgacgacggcgggcgcgcgagcgtgctgcaagcgttgaatccggcgcgcgcggccgacgacggtcggccgcatgcggccggcgtcgtgccgaatcggggcggcgagacgtcgcgcggtcgcgacagcggcatcggccggcggtttggcgtcgccggcgatggcgatgcgcggtaatcctggccggcgtgagcgacggtcggataaaagcacgcggtcaacgcgttcataccggtattcgtgccgggaatgaacgatcccaagcaaaggcgagcacctgccgggcccggagcgaccgtgccgccaggcaaaaactcgcggcgctcacccgttagcggtcgaagcgatccaacagccagccgctcgcgaccgagcccggcgcacgccccggttcaggaagccgcccatgatcgcgccttgtgcgctcgtatagccggcgcctttccccatctccgccgcaccaccccagcccgtttaggtgtttatacgtatgccgattccgatatcgcccgaatccaatatttcattggaaggttatcggacttgttcatagactgatgcggggcatgcagaccgggccggccgcacgcgccagcccggtctgcagcccgacccgcatccccgcgccacgcagaaccacaacagcgcagcggcatacaacgacatcatcggagacggaccatgacattcttcaggaagctgacggccggcgcgctcgtcgccgcggcgacggtgttcgcgcacggcgcgttcgcgcagcaaagccgatcacgctcgggttctcgcaggtcggcgcggaaagcgcgtggcgcaccgcgaacactgtgtcggtgaagggcgcggcgaaggacgccggcatcaacctgaaattctcggacgcgcagcagaagcaggagaaccagattcgcgcgatccgttcgttcatcgcgcagaaggtcgacgtgatcgcgttctcgccggtcgtcgaatcgggctgggaaccggtgctgaccgaagcgaaggccgcgcatatcccggtgatcctgaccgatcgcgcggtcgacgtgaaggacccgtcgctgtacgtgacgatgatcggttcggacttcctcgaggaagggcggcgcgccggccactggatggaagagcgctacaagaacgacgcgggcccgatcaatatcgtcgagctgcagggcaccgtcggctccgcgccggccaacgatcgtcgcgcgggcctgctcgaagtgatcaagaacaatccgaaattcaaggtgatcgcgtcgcagagcggcgacttcacgctcgccggcggcaagcaggtgatggaagcgttcgcgaagacctacggcaagcagatcaacgtcgtctacgcgcacaacgacgacatggcgctcggcgcgatccaggcgatggaagaagccgggatcaagcccggcaaggacgtgagcgtcgtgtcgttcgatgcgacgaagggcggtttccaggcgatgatcgccggcaagatcaacgtcgacgtcgaatgcagcccgctgctcggcccgcagctgatgagcgcggtgaaggacgtggtcgccggcaagcagctgcccaagcggatcgtcacgaacgagacggtgttcccgatgaacgtcgcggcccaggtgctgccgacccgcaagtactgatgtcccgcgcgggcggcggcgcggctgccgcccgagtcgcgaaccgcttcgcaaccgtttcgcaaccgtttcgacggaggggtcatgacgcaatcgccggtggtcgagatgaccggcatcgacaagtcatttccgggtgtcagcgcgctgcagcgcgtggacttccggttgtttcccggcgagatccatgcgctgatgggccagaacggcgcgggcaagtcgacgctgatcaacgtgctcaccggcgtgcatgcgcacgacgcgggcgagattcgcgtcggcggccggcccgtgcgcttcgccgcaccgcgcgaagccgaggcggccgggatccagacgctttaccaggaagtgaacctgtgcgcgaacctgtcggtcgccgagaacatcttcgcgggccggcagccgatgcggcgcggcgcgatcgactggaacgcgatccatgcgcgtgcgcgcgcggcgctcgcggaactcgacctgtcgctcgacgtcacgcgctcgctcgatgcgtacccgatcgccgtgcagcagatggtcgcgatcgcgcgcgccgtttccgtcgacgcgcgcgtgctgatcctcgacgaaccgacgtcgagcctcgacgacggcgaggtcgcgcggctgttcgacgtgctgcgccggctgaaggcgtcgggcatcgcgatcctgttcgtcacgcatttccttgagcagacctatgcggtgtccgaccggatcaccgtgatgcgcaacggcgagcgcgaaggcgagtacctggcgcgcgacctgccggtcgatgcgctggtcgcgaagatgaccggccgcgagcggatgtccgatacgctgcaggcgggtgccgcggccgccgtgcgcaccgcgggcgacgccgcgccgttcctgtcgatgcagcaggtcggccggcgcgggatgatgagcgcgctcgatctcgacgtgcggcccggcgagatcgtcgggctggccgggctgctcggctcggggcgtaccgaaaccgcgcagctcgcgtttgccgcggagcgcccggacaccggcgcgatcgagatcgacggcacgcgcacgcggcttgcgtcgccgcacgacgcggtgcggcacggcatcgcgtactgcccggaagaccgcaagaaggagggtatcgtcgccgcgctgtcgatccgcgagaacatcatcctcgcgctgcaggcgcggcgcggctggtggcggctgatcgggcgcgcgcgccagcgcgagatcgccgagtcgtatatcgcccggctcggcatcaaggcgcgcgacgcggagcagccgatcggcctgctgtcgggcggcaaccagcagaaggtgctgctcgcgcgctggctcgcgacggacccgaagctgctgattctcgacgaaccgacgcgcgggatcgacgtcgccgcgaagttcgacatcatggagcgcgtgctcgcgctgtgcaagaccgggctcgcgatcctgttcatctcgtcggagatcggcgaggtcgtgcgcgtgagccaccggatcgcggtgctgcgcgaccgtcgcaaggtcgccgagctgaccggcgccgatgcatccgaggagcaggtgtaccgtctgatcgcgggaggccagtcatgacgccgctgcgcacgctgtttcgtcattcgctcgcgtggccggtgctgacgctcgcgctgctgttcgcactcgatgtcgcgcatcgtccgggtttcctgtcgatcgcgctgctcgacggccacctgttcggcgcgccgatcgacatcctgaaccgcgcggcgccgctcgtgatcgtgtcgctcgggatgacgctcgtgatcgcgacgcgcgggatcgatatctcggtcggcgcgatcgtcgcgatcgccggcgcggccgcggcgatcgtgctcgacgccgatccgtcgcgggtcggtgccgcgctggccgccgcgctcggcgtcggcttgctcgcgggcgcctggaacgggctgctcgtcgcgttcgtcgggatgcagccgatcatcgcgacgctgatcctgatggtggccggccgcggcgtcgcgcagctgctgacgggcggccagatcatcccgatcggcgcgcccggctatctcgcgctcggcggcggttatctcgcgaccgtgccgtgcgcggtgtggatcgccgtcgcgacgatcgccgcgaccgcgctgctggtgaaccgcacggcgctcgggctgttcatacgcgcgatcggcgtgaatccggtcgcgacgcggctcgtcgggctgcgcgcgggtgcggtcgtgttcggcgtgtatctgtgttcgggcgtgatggcggcgctcgccggcatcctcgcgagttcgaatgtgcgcagcgccgacggcaacaacgccgggctgctgctcgaactcgacgcgatcctcgcggtgacgctcggcggcacgtcgctgctcggcggccgcttcagcctcgccggctcggtgctcggcgcgctgatcatccagacgctcacctacacgacctattcgatcggcgtgccgccggaggcgacgctcgtcgtcaaggcggtcgtcgtgatcgtcgtgacgctgatccagtcggaggcggcgcgcgcgctggtcgtccggcatgcgtcacggctgctgccatccgcgcgttcgcgcgccaccaccggagcgacgccccgatgacccgattccttggccggctcgccgacccgcgcacgctgccgatcgtcgtgacgatcctgctgttcgtcgcgctgttcggtttcgggtccgtgatgtacaccggatttttctcgatgcaggtgctcaccgggctgctcgtcgacaacgcgttcctgctgatcgtcgcgatcgggatgacgttcgtgatcgtgtcgggcgggatcgacctgtcggtcggctcggtcgttgcgctgacaacgatcctctgcgcggtcggcgccgagcggctgcattggccggtgtgggtcatcgtgccgctcgtgctggcgttcggcgcgctgtacggcgcggcgatgggtgcgctgatccattgctttcgcttgcagccgttcatcgtcacgctcgcggggatgtttctcgcgcgcggcgcgtgcttcctgatcacgacgcagtcgatcacgatcaacgagccgacgtttcatgcgatcgcgggcatcagcgtgccggtcggcggcggcacgctgagcgcgggcgcgctgatcgcgctcgcgacgctggccgccgcgatctacgtcgcgcatttcacgcggttcggccgcaacgtgtatgcgatcggcggcaacgaacgttcggcgctgctgatgggcttgccggtcgcgcgcacgaagatcggcgtctacgcgctgagcggcttctgctcggcgctcggcggcgtggtgttcacgctgtacgtgttgtcgggctacgggctgcaggcgcaggggatggagctcgacgcgatcgccgcgaccgtgatcggcggcacgctgcttacaggcggcgtgggctacgtgatcggctcggtgttcggggtcggcatcctcggcacgatccaggtgctgatcacgttcgacggcacgttgagctcgtggtggacgcggatcgtgatcggcgcgctgctgtgcgtgttctgcgtgcagcagcgggtgatcgagcggcatgccgcgcggcggcgcaccggcggcacggggctgggcgaacggccgcggccggccgacgccgcatcggcacggccggccgggacgggcgaggatgcggcgctcgtgtcgacgatgcggcgcgcgtaggggatcacaccgggatcacaccggggatcgcaccgcgcgtgcggcgcagcggggcgggatcgaccgggcagcggtgcgcgacgtagccgcgccgtcggcgcgcaccgcgtcaggcgcgaacgccgacgcggtactgcgtggtctgtcgatagacggcgcccggctgaacgatggcggcgtcgcgcaggtcgtccatgttgacctggtccggaaagccgccggcttcgacgcacagcgcggcgtgtcgcgcgcagcgcgtgccgccgctcacgcgcacgccgtccaggtagttgcccgtatagagttgcaggccgcgctgatccgtcgacacgagcagctcgcggccgctttccgggtcgtagatcgccgcgacgggcctgagcgcgtgcgcgccgtcgcgcagcacgaaacagtggtcgaacccgcgcgcccgcgcgagctgcgcgtgcggccagtcgaggcgcgcgccgagcggtgcgctgtgccggaagtcgaacgcggtgccggtcacgtcggcggtgccggtcgggatcagcgcgtcgtcgacttcgaggaacgcgtcggcgtcgatgctcagcacgtggccgcgcacgtcgccgcccgcgcggccgctgaggttgaaatagctgtgattcgtcaggttcagcggcgtgggcgcgtcggtgacgccggtgtagtcgatcgtcagcgtgccgtcgtcgtcgagcgcataacgaacctgcacgctcacgttgcctggaaaacccgcgtcgccttcgggcgaatcgagctgcagcgtcaacccgccgcaatcgtcgacgacggcccagcgctgccggtgaaagccgttcgcgccgccgtgcagcagattgccgcgctcgttgcgatcgagccggtagtcgacgccgtcgagcgtgaagcgcgcgccggcgatccggttcgcccagcggccgaccgtcgcgccgaggtaggcgctcgattcgacgtattcggcgggcgtgtcgtgcgcgagcacgatgtcggcgaagcgtccggcgcggtcgggcgcgagccacgacacgacggtcgcgccgaggtcgctgacgacgacgcgcatcccgtgcgcgttacgcagcgtatagcgccgcaccgcgtcgccgtcgggcagcgtgccccacggttcggaagggacgcgtgcgacgccgggcgccgggcggggagagtcggtatcgatatgcatgggtggattcgatgggtaaggccggcttcagtgcgcggcgatcgtgcgttcctggtattcgcgcggcgtgcatcccagctcgcggcggaataccgcgtacatgtactgaagcgacgtgaacccgcagcggatcgcgacttcggcgctcgacgcctgccggccggcaagcagcgcctgcgccgcttcgagcttgtggcgcaggatttcctggtgcacggtgcgctgcagttcgcgccggaagtgttcctcgagcagcgagcgcgacacgccgacgtagtcggcgacctgttccgtcttgatgccctggcacgcgtactggcgaatgaagtggcgcgcgcgcatcacgtaggggctcgtgagcggctggtggcgcgtcgattcgagcacgttgatcccgacgggcggcacgagaatgcgccggtcgggaaaacgcacgccgcgcagcatctggtgcagcaggtgcgcggcggtccggcccatttcctcggtgccctggatcacggacgacagcgggatgcgcgtcagcgtgcgcgtgagcggatcgttgtcgatgccgatgatcgcgacctgttccggcaccgcgaggccggcgataaggcaggcctgcagcaggtgccgcgcgcgcgtcggtcaccgcgatgatgccgacgggtttcggcagcgcgtgcagccagctgatcagctgctcgatcgcgtgattccatgccgatgcgctcgtcgacagcccgcggtagatcggcgcgtcgagcccgtccgcgcgcgcgagccggtcgaacgccagctcgcgctgctgcgcccagcggttctgctgcgcgtcgggcaggctgtacatcgcgaagtgcgcgagcccggcgccgatcaggtgcgtgtacgcgagcgacacgagcttcgcgttgtcggtcgcgatatacggcacgccgtccggatactgcgcgggatcttcgtaggacgagccgagcgcgacgatcggcagcggcgagccggcgagcgcgtcggcgacggccggatcgtcgaagtcggcaatgatgccgtcgccgtcgaaatgctcgatgccggcgagccggcagcggaagtcgtcctcgaggaacaggtcccacaccatgcgcgtcgagcgcaggtactggccgatgccgctgatgatctcgcggtcgtagaccttgttggcgttgaacagcagcgcgatgcggtgcggtgtctggctggaaggggcgcgggtcatctcggtctcgaggcgcgtgccgtgcggggcgtcgcgccgttgtctccgggtgcgcggacggtgccgcgcgcttgtctggtgtccggcgattgtaggacggaacgcgtgcggtgcgcagcgcgctggcaagaaacgttaagcgtgctgcgcaatttcgcaattgcgggggcgggggcgcgggcacgatccagccagaccgaattcggcccgcacgccaacgcgccgcgcgccgcactgcaacaagaaaccggacggagacgccatgtcgtatttcgaacagattcccgcgattcgctacgaaggtccgcaatcggacaacccgcttgcctaccgccattacgaccgcacgaagcaggtgctcggcaagacgctcgaggagcacctgcgcatcgcggtgtgctactggcacacgttcgtgtggccggggcacgacatgttcggccagggtgcgttccggcggccgtggcagcagccgggcgacccgctcgagcgggcgcggcagaaggcggatgcggcgttcgagttcttcacgaagctcggcacgccgttctatacgttccacgacaccgacgtcgcaccggaaggcgacagcctgcgcgagtacgtcgagaacttcgcgcggatgacggactacctgggcgagcgtcagcaggccacgggcgtgcggctgctgtggggcaccgcgaacctgttctcgcacccgcgcttcgcggcgggcgcggcgaccaacccgaatcccgacgtgttcgcgtgggcggcgacccaggtgcgccacgcgctcgacgcgacgcaccggctcggcggcgagaactacgtgctgtggggcggccgcgaaggctacgagacgctgctcaataccgatctcgtgcgcgagcgcgagcagttcgcgcgcttcctgtcgatggtcgtcgagcacaagcaccggatcggcttcaagggcgcgctgctgatcgagccgaagccgcaggagccgaccaagcaccagtacgactacgacgtcgcgaccgtgcacggtttcctcacgcaattcggattgcagaacgagatccgcgtgaacatcgaggcgaaccacgcgacgctcgccggccattcgttccatcacgagatcgcgaacgcgttcgcgctcggcgtgttcggcagcgtcgatgcgaatcgcggcgatccgcagaacggctgggacaccgaccagttcccgaacagcgtcgaggagctgacccttgcgttctacgagatcctgcgccacggcggcttcactaccggcggcatgaacttcgacgcgaaggtgcggcgccagagcgtcgatccggaagacctgttccacggccatgtgggcgcgatcgacgtgctcgcgctcgcgctcgagcgcgccgccgtgctggtcgcgaacgaccggctcgacgcgctgcgccggcagcgctacgcgcagtgggacagcgcgttcggccgcgagatcctgtcgggcggctatacgctggagtcgctcgccgccgacgcgctcgcgcgcggcgtgaacccgcagcatgcgagcggcgggcaggagcggctggagaacatcgtgaaccaggccatctacgggctgcgctgacgccatgtacatcggagtcgacctcggtacgtcgggcgtgaaggccgtgctgctcgaccgcgacggcgcggtgcgggccagcgcgagccggccgctggcggtgagccggccgcggccgcgctggtccgaacaggcgccgcgcgactggtgggacgcggcgtgcggcgcgctggcagcgctcgtcgccgatgcacgcgcggccggcatcgatccgcgcgccatcgatgcgctcggcctgaccgggcagatgcacggcgcgacgctgctcgatgcgcgcggcgacgtgctgcgccccgcgatcctgtggaacgacggccgcgcggatgcggagtgcgcggaactcgagcggcgcgcgcccacgctgcgcgccgtcgccggcaatctcgcgatgccgggctttaccgcgccgaagctgctgtgggtgcgccggcacgagccggacgtattcgcgcggatcgcccatgtgctgctgccgaaggattatctgcgctaccggttgaccggcgcgttcgcgaccgatccgtcggatgcggccggcacgctgtggctcgatgtcgcgaagcgcgattacgacgacacgctgctcgccgcatgcgggctctcgcgcgcagatgcccgccgtgttcgaaggcaaccgcatcaccggcacgctgctgccggccgtcgcacgcgcgctcgggttgcgcgagatcccggtcgtcgcgggcgggggcgacaacgcggccggcgcggtgggcgtcggcatcgtgcggcccggcgacgcgctgctgtcgctcggcacgtcgggcgtctacttcgcggtgtcggacggttttcgcgcgaatcccgaatcggcggttcacagtttctgtcacgcgttgccgcgcacctggcacctgatgtcggtgatgctgaatgcggccggctgcgtcgatttcaccgcgcagctggccggctacgacggcgttgccgcgctgctcgccgacgcggaagcgaacgcgcgcgcggagcgcccgtggttcctgccttacctgagcggcgagcgcacgccgtacaacgacgtgaatgcgaagggcgtgttctatgggatgacgcccgatacgcgtcgcgcggatctcgcgaatgcggcgctcgaaggcgtcggcttcgcgctgctcgacgggatcgacgcgctgcatgcggccgggctcgcgcccgacggcatcacggtgatcggcggcgggtcgcgcagcgcgtactggacgcagatactggccgacctgagcggccgcgcgctgaccttgcgcgcgggcggcgaagtcggcccggcgctcggtgccgcgcggctcgcgcatctcgcgctcgaaccggatgcgccgctcgacgcggtgtgcccgcagccgccggtcgtcgcggtacgggagcccgacatggcgcgccacgcgtggtatcgcgacgcgcggcggccgacgtttcgcgcgctgtatcgggcgctcgagccggtgtttgcgacaggcgcgtgacgggcgtgtgacaggccgcacgaagccgtgccgcgcggtggcaagacgatgggcgaccggcttcggcggctgcccggcgttcgtggagtagtccaataaagagaggaatggagacagacatgaaatccgtaacgcgtcgtaccgtattgaatgcactggccggcgccgccgcgctggcggtcctcgcgctgggcgccccgctcgcgcatgcgagcaaggacaagcctgaaatcggcttctgcatcgacgacctgcgcgtcgagcgctggtcgcgcgaccgcgactatttcgtggccgccgcgacgaagctcggcgcgaaggtgtccgtgcagtccgcggacgcgagcgaggcgcggcagatctcgcagatcgagaacctgatctcgcgcggcgtggacgtgatcgtgatcgtcccgttcaactcgaagacgctcggcaacgtggtcgccgaagcgcgcaaggccggtatcaaggtggtgtcttatgaccggctgatcctcgacgccgacgtcgacgcatacatctcgttcgacaacgagaaggtcggcgaactgcaggcgcagggcgtcgtcgacgcgaagccgaagggcaactatttcctgctcggcggcgcgccgaccgacaacaacgcgaagatgctgcgcgaagggcgctgaaggtgctgaagccggcgatcgatcgcggcgacatcaaggtcgtcggccagcagtgggtgccggagtggagcgcgtcgaccgcactgcggatcgtcgaggatgcgctgaccgcgaacaacaaccggatcgacgcgatcgtcgcgtcgaacgacggcaccgcgggcggcgcgatccaggcgctcgccgcgcagcacctggccggcaaggtgccggtgtccgggcaggacgcggatctcgccgcggtcaagcgcgtgatcgccggcacgcagacgatgaccgtctacaagccgctcaagctgatcgcgagcgaagcggcgaaactcgcggtggatctcgcgaagggcacgaaacccgcgttcaacgcgcaatacgacaacggcaagaagaaggtcgacacggtgctgctgcagccgacgctgttgaccaagcgcaacgtcgacgtcgtcgtgaaggacggcttctatacccaggcgcagctggcgagccagtaacggcgcggcgcgcgggcggcccaccggtgcgtccgcgcgcacactgcgaggcatgagcgaatgaccgaacccttgctgacgatgcgcggcatcgtcaaggaattcgacggcgtgaaggcgctcgacggcatcgacctggtggtgcggccgggcgagtgcgtggggctgtgcggcgagaacggcgcgggcaaatcgacgctgatgaaggtgctgtcgggcgtgtatccgcacggcacgtgggagggcgagatccgctgggagggcgcgccgctcgtcgcgtccggcgtgcgcgacaccgagcgcgcgggcatcgtgatcatccaccaggaactgatgctcgtgcccgagctgtcggtggccgagaacatctttctcggcaacgagatcacgctgccgggcggacgcatgaactatgcggcgatggtgcagcgtgccgaggcgctgctgcatgaactgcggatcgactcgatcaacgtcgcgcagccggtgatgaactacggcggcggccaccagcagctgatcgagatcgcgaaggcgctgaacaagcgcgcgaagctgctgatcctcgacgaaccttcgtcgtcgctgagcgcgtccgaaacgcgcatcctgctcgacatcgtgcgcgacctgaagcgccgcggcgtcgcgtgcgtacatctcgcacaagctcgacgaggtcgaggcggtgtgcgacacggtgacggtgatccgcgacggccgccatgtcgcgaccgagccgatgcgcgcgctgacgaccgaccggatcatcgcgatgatggtcggccgcgagattcgcgatttgtacccgcgcgagccgcacgagatcggcgacgtcgtgctggaagcgcgcaacgtcacctgccgcgacgtgacgaatccgcgccgcaagcgggtggacgacgtgtcgttcagcgtgcggcgcggcgagattctcggcgtcgcggggctcgtcggcgcgggccggaccgagctgatgcaggcgatcttcggcgcgtatccgggcgcgtgcacggcgaccgtgctgatgaacggccggccgctgtcgatccgcacgcccgccgacgcgatccgtgccggcatcgcgatggtgcccgaggaccgcaagcgccacggcatcgtgccgcagctcggtgtcggccacaacatcacgctgacggtgctgcggcgcttcgcggcgcgcgggcggatcgacgcggccgccgagctggacgcgatccgcaccgagatgcagcggctgtcggtgcgtgccgcgcatccgttcctgccgatcgcgagcctgtccggcggcaaccagcagaaggccgtgctcgcgaagatgctgctggccgagccgcaggtgctgattctcgacgagccgacacgcggcgtcgacgtgggcgcgaaagcggagatctaccgcctcgtgttcgcgctcgcgaagcgcggcgtcgcgctgatcgtcgtgtcgtcggaaatgcccgaggtgctcgggcttgccgatcgcgtactggtgatcggcgaaggcgagctgcgcggcgacttcgtcaacgacggcctgacacaggaacagatcctcggcgccgcgctgaaatccggccggcggccgaccgaacccaccgcaacgagtgcgacatgaattccgaactttcttcctccaccccggcgacgcaggacgcggacgcgcgccgttcaagcggccacgaagcagggcacccggccgggcgctcgaccggcagccagcttcgccaggtattcgtgcgctacaagatcctcgcgctgctgctcgcggtcgcggcgatctgggcgttcttctcggtgctgaccgacggcgcgttcgtcacgccgcgcaacgtgtcgaacctgctgcggcagatgtcgatcaccggcatgctcgcgtgcggaatggtgttcgtgatcatcgcgggcgagatcgacctgtcggtcggctcgctgctcgggctgctcggcggcgtcgcggcgatcctcgacgtgaaccgccactggcccgtcgccgcgacggtcccggcggtgctcgcgctcggtgtgctgatcggactcttcaacggctggtggtcgacctaccggcgcgtgccgtcgttcatcgtcgggctcggcgggatgctcgcgtttcgcgggatcctgctcggcgtgacgggcggctcgacgatcgccccggtgtccgacggcttcgtgttcctcgggcagggttacctgccgcgcgtggccggcgacggcctcgcgctgctgctgttcgcgctcgtcgcgctgctggtcgtgcgccagcgcggcacgcggcaccgctatcggctcgcggtcgcgccgctgtggcaggacgccgtcaagatcgtgggcgcggggccgtgctgttcgcgttcgtcgcgacgctcgaccgctacggcggcattccggtgccggtgctgttgctgctcgcgctgctcggggtgttctcgtggatcgcgacgcagaccgtgttcggccggcgcatttatgcggtgggctcgaatctcgaggcgacgcggctgtccggcgtcgataccgaccgcgtgaagctcgcgatcttcgcgctgatggggctgatgtgcgcgttcgccggcatcgtgaacaccgcgcggctcgcggccggttcgccgtcggcgggcacgatgggcgaactcgacgcgatcgccgcgtgcttcatcggcggcacgtcgatgcgcggcggctcgggcaccgtgtacggcgcgctgatcggtgcgctcgtgatggcgagcctcgacaacggcatgtcgatgctcgacgtcgacgcgtactggcagatgatcgtcaagggcgcggtgctggtgctggcggtgtggatcgacgtggtgtcgcggtcgaaccggcggtgaggcgtcgcgccctggccgcctgtcaacgggaggtggacatgaaacggaacacggtaccgatgcgcgggatctccatgctgacggcgtcgccgctcgcgacgccggccgtcgaatacgatcacggggccgcgctcggcctgggcgatccgcgcgaccgccggatcatcgcggatgcgctgcgcacgctgttgcgggagcgctcggaagcgctcgcgttcgcgatgcgcgcggcggacgagcacgatcgtccgaggccggacgcgaacgatttcgcgctgaccgacatcatccggctcgcgcgcatcgtcgagcgcgcggagcgatacggcgacgcgatgaacgagcccgttccgggcgctgcgcgctgatacatgaatggcctggccggcgccgttcgcgcgagattgcgcgaggttgtgcgtcgaccgaacaatttcgcactggaaagcggctgaagcgggcgtcgacacgatccgtggtcgcggcccggctcgttttgccgtcgcgacggttcgcgacggcgaaacctcctgaacgcgcgcgggcggccgttacggcagcggcgcaccccacaccgcgctcacgtcgccgccattcgctgaacgggcggcgcggcgcgatgatcgccggcagggggcgatcgccgaagcgcgtagtacggctcgacccagctcagctcgtcgcggaacgtccacgggaacaggtcctgcctgaccggcgtgatcgccctgaaactgtcgggattttccaccgcgtccggccggaggcagtctagcggttcgatctttcagcggcctttcccgatggcggccgctgccgtccggcgcgatggcctgcccgatccggcaggccggcggcgcgggtcccggcgtcgtatgctttacgttatcctgtcgccctcgaccgcctgcccgatccgatgaagcgtccgccgttttccactcaactcgtcatgctctgggcgctcgtcgcgacgctctgcgcgacgctcgtcgcggtcgtctgggtgatggccagttccgccgaagggcagcagatcgccggcgcgcgggccgcgggcgaagcggcctgcgaagcggtcgcgtcgcgctacgatgcgtccgcgccggccggcgcgcagcccgattcggcgctgatgcatgcgatcctcgatatcgttttggcgcgcgcgccggacatggaaggcggtttctggacggccggcggcgcacccgcggcgagcggttttcttgcgtattcctttccgacttatcaaggcagcggcatcaagcgcgacgtgccggacgcggaaacaccgctgattctccgcacgctgcgcgcggccgccgcgacgcgtgccacgacgtcgaatgccgtcgagggcgcgcaggatgcggtgatcgcggcggcatgtccggttcgcgccggatcggggctgttcgtctggatgctgacgcgcgcccgcccgccgctcggccggcacggcgagctgctggcgacgggccttgccggcgtgctcgcggtgattctcgcgatcgcggcggcgctcgccatcgcgctgcggcgctggaaaggcaatctcgcgcggatcgaggccgggttggcgcccgacggccgcgcaccgcacctgccgtatgtcggcgagcccgatctcgaccggatcatcgatgcgttcaacgcgcatgcacggcgcgccgagcaactgcaacagcaggccgccgaactccgcacgcggctcgcgcaggcggaacgcttcgggatgctcggcaaactggccgcgcaggtcgcgcacgagattcgcaacccgatgggcgcgatgcgcctgaaagccgaaaacgcgctggccggcgacagccgacggcagcaggacgcgctgcgcgtgatcctggcgcagatcgaacgcatcgatgcgcagctgtcgggcctgctcgcgctgacgcagccggtcagcccgcatgcgacgcgcgtcgatgtcgacgcgtggctcgcgcaggtcgtcgacgcgcaccgcgagctggcgcagcggcaggcgatcgatctcgcatggctgcccggcgagcagggcgaacgccttgcgcagcccgccgcgttccccgtgttcgatcccgaccagatgcgtcgcgcgctcgacaacctgttgctcaacgcgctgcgccatgccggcgacggcggtgcggtcacgctcgccgccgcgcgtcgcacgttcgccggacgcgactggctgaggatcaccgtgtcggataccggccccggggttcccgccgagcagcgcgagcggattttcgagccgttcgtgacggggcgggcggacggcaccggcctcggtcttgccgtcgtccgcgaagtggccgcggcgcatggcggccaggcctggctcgacgacgttccgcacggcgcatccttcgtcattgaaatcccatggcaaccatcctcatagtcgacgacgacgcggcatttcgcgacggcctggccgagacgctcgccgatctcggtcatcgggtcgtcgaagccggagccgggcgcgcggcgttgagcgcgctgcgcgacggcggccgcgtcgattgcatctttctggatttccgcttgccggacctcgacgggctcgcggtgctcgcgcagttgcgcgacgatcccgcgctggccgcgatcccggtcgtgatgctgaccgcccatgcgaccagcgacaacacgatcgacgcgatgcggctcggcgcgttcgatcacctgaccaagccgatcgggcgtcgcgacatcgcgcaactgctcgcgcgcgtcgtttccgcgaacacaccgccggcggccgtcgagccgcactgcggcgggtttgcgcgcgaacccgcgtcggcccgcccccggctgctgggcgtgagcgccgcgatgcgcgacgtgcagaagcagatcggccgggccgcgacgagcgacgcgaccgtgctcgtcaccggcgagacgggcaccggcaaggaagtggcggcgcgcgtgttgcatgccgcgtcgatgcggcatgccgggccgttcgtcgcggtcaactgcgcggcgattccggccgacctgctcgaaagcgaactgttcgggcatcgacgcggcgcgtttacggggcgcacgtcgatcgcgccgggcggctcgtcgaggccgacggcggcacgctgtttctcgacgagatcggcgacatgcccacggccatgcaggccaagctgttgcgcgcgctgcaggagcgcgaggtgacgccgctcggtgcggatcgtccgacggcgatcgacatccgggtggtggccgcgacgcaccgcgatctcgccgaggccgtcgcgaacggcacgtttcgcgaagacctgttctaccggctgaacgtgattccgctgcacctgccgccgctcgcggatcgcgtggccgacatcctgccgctggccgcgcatttcctggcgtgcgcggcaggcgcgcgcccgttgcacctgacgaacgacgcacagcgggcgctgctcgatcatcgctggcccggcaacgtgcgtgagctgcgcaacgtgatggagcgggcggccgcgctggcgcccgggccggccatcggcgcggccgatctcgggctcggcgtcgtggcggcgccggcgcccggcggcgacgcgcttgcgctgcccgcgccgctgttcgacatgccgttgcccgacgcgctggcggcggtcgagcgcgccgcgatcctgcgcgcgctcgagcgcgcgaacggcaatcgcgcggaggcggcacggcagctcggcatcggccgtcagtcgctctatgcgcgcatggcccatctgggtatcgagcgcgacgagtagcggcgccatgacgcctgtcgggattcccgacaacggcgggtaagacgtgtcgggaatcccgacacgttgtgcacggttcatcgttcgatacgccgcccggcgggcacgtgcgtgctggcacgcgtgttgcagatatcacggcatcgcaacccgttgccggagcccgtcatgaagtcgatcccacgcgccgccgttcgccgcagctgtgtcggactgtgtgccgccgcgctgatcgccgcggcgacagcctgcgccgcgcagattccacccgcgccgcgtgcggacgaaccgcccggcgcgccgccgcgcgccggtttcgaaccggctcctcttcctcctccgccgctgtcgcccgtcgcctccgacgcactcgtgtccggcacgctttcgcgcctgacgatcaacccggaaggcgcggtcgacggtttcgtgctgaccgacgggacgctcgtcggcgtgccgccgcatctcggcacgcaactgatcgcgctcgcgcggccgggcgaccgggtaacggtggccggcgaacgtcgcgccggcgacgacatccacgcgcgcgtcgtgcgcaacgaccgcagcggcgcatcgttgtccgaccagccgccgccatccgccgcgccgatgccgcccgcgctgcgcggcgtcaatctggcccgcctcagcgtgtcgggtgtcgtgcggcgcgtcatgcgcgcaccacgcggcgagcctgacggcgtgatgctcgacagcggcgcgatcgtcaagctgacggtgccggccgcgcagcagttcggcgcgctgctcgtacccggcgcgcgcgttgccgcggtcggatacggcacgcgcaatgcctacggcgaagcgctgcaggccaccgcattcggctcgccgggccgtgtcgtgaatctttatgacgacgtcgtgcgctgatcgcacgtcgttttcctgccatcccacaaggagtcctgccatgcactggatcgatcccgcctgcctgcccgaaacgcgcggccgcgtcacacagttcctgctcaacccgcacggggacatcgacggcctgatcctgaacggcgacctgcaggttcacgtgccgccgcacctgggccgcgaactggttcgccatgtcgaggtgggcgaccgcatccgcgtgcgcggcgtcaagtcgcgcggcgccgcgatgatcgtggcggtgcagctgaccgggcgccacggcgtcgacatcgtcgacgacgggccggtgcccggtgcgccgaagccgccgcatggcggccgcaagctgatggagatgagcggcgaagtcgcgttcgcgctgcacggcccgaaaggcgagctgaacggcgcgttgctgacgaacggtgtcgtgctgcggatgccgccgcatgcggcagccgagctgagcgactatctgcgcgccggtatccacgtcatggcgtgggggcaaggcgtcgtcacgcggtacggcgccgtgctcgaagtgagcgagatcgccgagctcgtcgacgcggacgacgaatgactgcccgtcgacgatgagagcggcgcgcgcgctcgaggcgctcaatttcttcctggccgacgtgcaggccggtatcggcccgttcgtcggcgtgatcctgctgtcgcgcggctggagcgccgacgcgatcggctcggtcatgacgctggccgggctcgccgcgatggccgcgacgccgccggccggcgcgctcgtcgatgcgctgcgcgcgaagcgcgcgctgatcgtcacggccaccgccgtgacggcgctggcctcgctggcactgatgttcgccgacggttatccggcggtggcggcgtcgcagatcctggccgccgtcggcggcgcggcgctggcgccggccgtcgcgggcgtgacgctcggcatcgcgcgccggcagggtttcgaccggcagttcggccgcaaccagatggcgaaccatgcgggcaacgtggtcggcgcggcgctcgccggatggctcggctggcatgcgggattcgacgcggtgttcgcgctcgtcgccgtgttcacgctcctcgcgatcgcgagtacgttggcgattcccgcacgggccatcgaccacgcgtgcgcacgcggcctcgacatggacgatgtcgagccgcgaacgcatgccgtgcgcgatgatccgcccatgggcgcgtcggcgccgcccgccggcggctggcgcacgctcgcctcgaaccggccgctggtcctgctcggcgcgtcgctcgcgctgtttcatctcggcaacgcggcgatgctgccgctctacggaatgggcgtggtcgccacgcatcgcagtaacgcgagcatgttcactgcgcaaaccatcgttatcgcgcagctcgtgatgatcgcggccgcttgggtcgcgccccggctgattcgcgcgcacggttattggcgcgtgctgctgctttcctacctggtgttgccggtgcggggcgtgcttgccgccgtgctgatgagcgaggcgggcgtctggccggtgcaggtgctcgacggcatcggcgccggcctgcaaagcgtcgtcgtgccggcgctcgtcgtgcgcctgctgcacggctccggccgcgtgaacgccgggcagggcgccgtcgcgaccgcgcaagggatcggcgcggcgctcagtcccgtgctgggcggcgtgctcgcgcagcacttcggttatccggtcgcattcgtcgtgctgggcgccgtgtcgacgggcgcgctcgcgctctggctcggccatgcgcgagcgctgagcagcgtgtgcggcaagccggccgacctgccggccgcgtcgtcctgaacgtgctttcctctccctgcgattcccgacctgcccatgaattccgtttcacttgcatggctgatttccgcgctcgccacggcgggcgtcattgcccgcccgttcggctggcccgaggcaacctgggccgtgagcggtgcgttgctgctggtcgtgtgcggcctgttgcccgtgcatccggcgctcgacgccgtcgcgaagggcggcgacgtgtacctgttcctgaccggcatgatgctgctgtccgaggtcgcgcggcgcgaagggctgttcgactgggtcgcgacgcgcgtcgtcaatctcgcgcagggttcgccccggcgcctgttcgcgctcgtctacctggtgggcaccgtgacgacggtcttcctgtcgaacgatgcgaccgccgtcgtgctgacgcccgcggtcatcgcggccgcgcgccgggcgaaggcggatccgttgccgctgctgtacatctgcgcgttcgtcgcgaacgcggcgagtttcgtgctgccgatctcgaaccccgcgaatctcgtgctgtacggcgcgcgcatgccgtcgctcggcgtatggctggcccacttcgcgatcccgtccgccgcatcgatcgcatgcacgttcctgatgcttcggatgacccagcggcacgcgctcggcggccggtgcgaatccggtttgccgacccggccgctcaccggcggcgggcgtatcgcgctggccggcatcgcgatcacggccgccgcgctgatgacggtgtcggcgctcgatcttccgctcgggttgccgaccgcggccgcgggtatcgtcaccgtcgcatgcgtgctggtcaaggatcgcaccgcatgcgtgccgatcgttcgcgcgatttcatggagcgtgttgccgctcgtcgcggggctgttcgtactcgtcgaggcgctcgaccggagcggtgcggtgcgtgcgctcgccgggctgctgcgcgcgctgacggcaagcggcgagcagaccgccgcggccgcggcgggcattgcgatcgcactggcgtcgaacctggtcaacaacctgcctgccgggctcatcgcgagttcgacggtcgacgccgcacgcagcccgcaaacggtgatcgacgcgatcctgatcggcgtcgacctggggccgaacctgtccgtcaccggatcgctcgcgacgattctgtggctcgcggccatccggcgcgaagggttgcgggtcggtttcggcgcgttcctcgcggtcggcgcgtgcgtgatgttgccggccttgttgctcgcgctggcggcgcggctcgcgctcggcgcgtgaagcgcatgagtcgcagcgccggccggccaaccccggctagaacgtataggcgagcgacgcgaacaggctgcgcggcgcgcccggcgtgacccacaagctgttgtaggagctgacgtaggtggtgcggttgaacaggttgttcagcacgaccgacgcacgcaggtgcttgttgacctgcacatagccgttcagctgcacggtcgcataggccggcagctcgaacccgtcctgcgtgttcgcggtattgccggcccggcgcccgacgtagatcaggccggcgccggcaccggccttgtccgcgaacggtaccgcggtttcgtacaggagcagcgcgctgccgctcaggcgcggaatgtcgacgaggcgtgcgccgggtgtcagcaccgcgtcgtgcgtgacttcggcgtcgacatacgcaaggttgacgaggccgcgcacgccgtggccgaggtcgccgttccattcgaattcgacgccgcggctgcgcacctcgccggccgcgcgcgagaagccggcgttcgccggatcggcggtcagcacgttgcgcttgttgacgtagaacgccgcgacggtcgcgagccagcgcgcgccggcccatttcgcgccggcttcgtagccgtgccccttctccggatcgaacgcgcggccgtcgacgtcggcgccgttgttcggccggaacgaatacgcggtgttcgcatagagcgacagggcggggctcatctcgtacacgatgccgatgcgcgggctcaacgcggtctgcacctggctgctcgtcgtgcctttcaggcggttctcgaccgactggtggaagcgatcccagcgcagcccggcgaggattttccagtgcgggccgaacgcgagcgtgtcctgcgcgtagagcccctggccgtcgtcgcgctcgagcaggttggtcgcggtgcgcggcgtgggcgccggctggccgtagacgggatcgaagatgtcgatcgcatacggcgcggcggccgtgggcgtcgagcgtgcgacgaactggtcgtaattgaagcggtacgcatcgacgcccagcacgagcgtgtggccgatgccgccggtgcggaacttgccggccgtttcgatgcggccctgcaggtcgttcgaatgaaacgcgacttgccggtagcggcgccacagcgtgcggccgtccggctgcagcgcgaatgcctcggacgagcggccggacaggtcggtggtgcgctgcgcgaacccggcgttgaccgaccagttcgcatcgacgcgatgctcgagcgtgaactgatggcccgtgttgcgcacgtcgtagtcgccgtcgcgcggctcgccgaggaagcgcgatgcgggaatcgcaccgagctgcccgcccaccgcgaccacgccgcgatcgagcggcgcgcgctggcgcgcactcgaattcgtaatgaagcgtcgtatccgcaccgatatcccacgtgaacgacggcgcgaacaggtagcgtttgctcgacacggtatcgcggaagctgccgttgttctcgttcatcgcgacgaagcggtacgcgagcgacttcgtcacggggccggtcgaatcgagcgtctcgcgcaatgcgccgtagctgccggccgacacgccgacggtgttcgcgcgcgcgaactgcggctgcttcgtcgtgtagctgatgagcccgcccggatcgccgcgcccgtacagcgccgacgcgggccccttgagcacttccatgcgctcgaggttggcggtgtcgcgcggcacgctgatcccgcgattccacgaaaagccgttgacgaggtagtcggtgccggacgtgttgccgtcgccggcgaagccgcgcactgcgtagttgtcccaaagaccgccgaagttgttctgccgcgcgacgcccgcgacccagtcgtacaggtcctcgccgcgcgtcgccgcgaccgtgcgcacgagtttcgcatcgacgctgctgaccgcgaacgggatctccatcacgtccgcgtcgccgcgcgtcgcgctcgtcgagtcacgcgtgcgaaacggtgcgctcgcgcgctgccccgagatctcgatggtgggcagcgtcgcctcctgcgcgtcggccgtgcccacgccggccgcgccgacgacgatggccatcggtgcggccgcccagttcctcctgctcatacctctccctttcgtgtcgttcgcgttcgggcacggcgggcggccttgcgccgacatcggtgttccaaacagtacatttgcgcggcaatttaatgcaaatgagaggcatttgcaatcgtaattttgaggattggtacggggagcgaaacggtggggcgcacggatgcgagcgaggggatgggtggatttcctgaaatgccgaacggcgggaaaacaaaccatggcgtggtgacggccggatagcgctttcgtcacgcctgcgcgagaaatatgagtgaaattgcagggggcacggcgccacgcgatgcacgacaccgcgctcgccgacgcgcgccggcgcccgtgcgtgttcagctcaatccggatcggctttcagcccaccctcgatccaccgcgcttccgacgcgcgaagatgcgcgcgaatggccgtctgcgcggcgatcggatcgccggcctgcaacgcgagcagcacgtcctcgtgctcgcgcaccgcggcggtccacgtctgcggattctccgcatggccgcgcatcgcggccgcgatcgggtcgtggcggctgtcgaacagctcgccgacgaagcgggtgagcaccgagttgccggcggcttccgcgatcagcatgtggaactgccggtcggcttcgaccggggatttgccggcctccgcgagccgcttcatgcgctgaacggtgcggcgcagccgctcgagcatggcggccgtcatccgcgctgcggccagcgcggcgacgctgccttcgacggccgcgcgagcctgcatcaattccgacggactgtcgccgagcgtggccatcgggccgacagcgtcggcggccgtatcgcgcacatagacgccggagcccatccggatttcgatctgcccgccgatttccagcgcgatcagcgcctcccgaagcgacggccgcgacacgccgagcgtcagcgccagctcgcgctcgggcggcagccgctcgccgatcgcgaattcgccctggcgaatcaacgcgacgatctgggccgcgaccgattggtaaagccgcttgggttctgtcgatttcatccgagtgatagggatcaatgcgcttcgggcgcaagcgcgtgtcgcggagtctatcacgccggacgcatcgccccgtgtagcggcgcgttcatccggatgtccgggttttcactattggtaagatcagatgtgaataattaaattggcttgaccaaaatggctttgattgctgtaattcatccaaattggactgaccggttagtgtcgaggtcgatccatccccaggagacgcaatggcaatgcctcgcaatctgcccggtcaggccgcgcaggacgaaccggaccgggagatcctgcgcctggacgggattcgcaagcgcttccccggcgtcctcgcgctcgacgggattcgcctcgacctgcgccgcggcgaggtgcatgcggtgtgcggcgagaacggcgcaggcaaatcgacgctgatgaagatcatcagcggccagtacctgcccgacgacggtgtcgttcactatcgcggcgcgccggtgcggtttcattcggcctccgaagcgcaggcggccggcatctcgatcattcatcaggagctcaatctcgtcccgcacctgagcgtggcggagaacctgttcctcgcgcgcgagccgcggcgcgggccgttcgtcgatacgaaacgcatgaacgcggaggcggcgcgctgcatcgcgcgcatcggcctgaacgtcgcgccgacgacgaaggtcggcgtgctgtccatcgcgcagcagcagatggtcgagatcgcgaaggcgctgtcgcacgatgcgcgtgtgctgatcatggacgaacccacgtcgtcgctgaccgaaacggaaacggtgcagctgtttcgcatcatcgaggaactgcgcgccgacggcgtggcgattctgtatatctcgcaccggctcgacgaaatggcgcagatcgtcgatcgcgtgacggtgctgcgcgacgggcgccacatctcgacggacgctttcgccgacgtgagcatcgacgacatcgtcgcgcgcatggtcggacgcacgctcgacgacgcctatccgtcgcggcaatcggtgccgaccgacgaggtgctgctcgacgtgcgggacctgcgccgcgacggcgtgttcgggccggtgtcgttcgcgctgcgccgcggcgagatcctcggtttcgcgggcttgatgggcgccgggcgcaccgagatcgcccgcgcgatcttcggcgcggatcgccccgacggcggcacgatcgggctgcacggccggcccgtgacgatccgctcgccgcgcgaggcgatccggcacggcatcgcgtatctgtcggaggaccgcaagaaggagggtctcgcgctgccgatgcccgtcgcggcgaacctcacgctcgcgaacgtgcgcggcatcacgtcacgcttcgattcctgcgcttcgacgacgaactcgacgtcgcgcgccgctacgtgcaggacctcgcgattcgcacgccgtccgtgcaccagcgcgtccgaaacttgtccggcggcaaccagcagaaggtcgtcatcggcaaatggctgtaccgcggctcgaagatcctgttcttcgacgagccgacgcgcggcatcgacgtcggcgcgaaattcgcgatctacgggctgatggaccggctcgccgccgacggcgtcggcgtggtgctgatcagttcggaactgcccgaactgctcggcatgaccgaccggatcgccgtttttcacgaaggtcgattgaccgcatttctcgatacgaaacacaccagtcaggaggagatcatgcactacgcgtcggggcgttcccatgcttgaaatgacatccgatcgaagccaggccgacgaacgggcggcgcgacagcggcggcgcgacctgatccagaagttcgcggcgctgggcagtctcgtcgtgctcgtgttcgcgttctcgatctcgagcgcggcgttcttctcggtcgacaacctgatgacggtcggcctgcaggtcacgtcgatcgcctatctgggcgtggccgccacctgcgtgatcatcacgggcggcatcgacctgtcggtcggctcggtgctcgcgctggccggcgtgtgcgcggcgctgctggtcaaggccggtgtgccggtgcccgcggcgatggcggccggcatcctggtcggcgcgctgtgcgggctcgtcaacggcatctgcgtgacgcagatgggcctgccgccgttcatcgcgacgctcggcatgatgctcgtcgcgcgcggcatcgcgttgcagatcaccggcgcgcggccggtatcggatctcggcgatgcgttcggcgcgctcggcaacggcgcgctgctgcggatctcgcgcatcggcgcggacgggttcccgacacgacctttcccggcattccgtatccggtcgtgatcatggtcgtgctgttcgtcgtggtgtccgtgctgctgtcgagaacgtcgctcggccgccatatctacgcggtcgggtcgaacgcggaagccgcccggctgtcgggcgtgaacgtgcagggcgtgaagctgttcacctacgtgctgtccggcgcgctcgcgggcgtgaccggttgcgtgctgatgtcgcggctcgtcaccgggcagccgaacgaaggcgtgatgtacgagctcgacgcgatcgccagttcggtcatcggcggcacgtcgctgatgggcggcgtcggcacgatctccggcacggcgatcggcgcgttcgtgatcggcgtgctgcgcaacggcctgaacatgaacggcgtgtcgagcttcatccagcagatcatcatcggcgtcgtgatcctcggcacggtgtggatcgaccagttgcgcaatcgccggccctgaccggcagcaagcagtccctaccaacgagaagcggagcgagacatgaacaaatccatcctgctggcggcatcggcgtgcgtgttcgcggtgtgcagcagtggcgcgtatgcggcgggcggcgagatcgccgtgatcgtcaagacggtcaattcgaactactggcagaacgtgcagaagggcgcgaaggcggcgctcggcggcgccaagggttacacgatgacgttccagggcccggcggccgagtccgacatcagcgggcaggtcaacatggtcgacaacgcggttacgcgtcatgtggcgggcatcgtgctcgcgccgtccgatcccgatgcgctcgtgcccgcgatcaagaaggcgtgggaagcgcacattcccgtcgtgttgatcgactcggcgatcgcggacgcgggcaagccgtactaccaggcattcctgtcgaccgacaacgagaaggcgggcgcgctgtgcgcgaaggcgctgatcgaccgcgtcgggcagtcgggcaagatcgcgatcatgtcgtacgtgccgggcgcgggctccgaggtcagccgcgtcggcgggttccgcaagtacatcgagagccattcgaagctgcaggtcgtcggcccgtactactcgcaatcgcaaatggcgaccgcgctgaaccagacgaccgacgtgctgtcggcgaacccggacctgaagggcatcttcggcgcgaacgagccgaccgcggtcggcatgggccgtgcgctgaagcagtcgggcaaggcgggcaaggtggtggcgatcgggttcgacggcaacgaggacctgcagggcttcgtgcgcgacggcaccgtgcaggcgatcgccgtgcagggctcgtggcagatggggaaccagggcgtgcgcacggcgctcgacgtgatcgagcgcaagcccgcgccgaagctgatcgataccggcgtcgtgatggtcgacaagcagaacctcgattcgcaggcagcgaagaatgtcctgtactgatcgcccgtgccgcttgcacgcatcgagtcaccactcatgaacgcaaacgatacgcgcaccttgccgcgcagtaggctgacggtgtccgcgctcggcctcggctgctcgcagctcggcggcctttatcggccgatgtcggcggccgacgccgccgcgctggtcgacgccgcgtgggctgccggcctgcgctacttcgacaccgcgccgtattacggctacacgctgtccgagcggcgcgtggggcggggctcgctccgcgcgagcgcagcgcgttcacgctcagcacgaaggtcgggcggctgatgcgcgccgacgcgagcgtgcggccgggcgacgacggctgggccgagccgctgccgttccggcccgtctacgactacagctacgacggcatcatgcgctcgcacgacgacagccggcaacggctcgggctcgcgcggatcgacatgctgtacgtgcacgacatcggcgcgatgacgcacggcgatcgtcacgcgcactactgggaacagttgacgcgcggcggcggatttcgcgcgctggatgcgctgcgcgccagcggcgagatcggcgcgttcggtctcggcgtgaacgaatgggaagtcgcggccgacgcgctgaacgaagcggcgctcgatgcggtgctgctggccggccgctacacgctgctcgaacagacggcgctcgaaccgctgctcgacgcgtgcgcccgtgacaggacggcgatcgtgatcggcggcgtgttcaattccggcctgctcgccggcaacggcaagttcaactatgcggacgcgagcgccgacgtgatcgacaaggccacgcggctcggcgcgctgtgcaaccgcttcgacgtgccgcttcccgccgcggcattgcagtttccgttcggtcatccagccgtcgtatcgtgcgtggtcggcgcgcgcagcgtggcgcagttgaagcagaacgtcgactggttcgagcgtcccgcgccggccgaactgggatgcgctgcgcgacgaagggttgatcgcggcacacgcgccggttccgggagcccacgcatgaccatgcgcatcgacgcccatcagcactactggcgcatcgacgcacgggccggctgctggccgccggccgaactcgatgcgattcaccgggatttcggcccggccgatctggcgccgctgctcgacgctgcgcgcatcgacaccaccgtcctcgtgcaatcgctgccgagcgaagccgacacgcgctttctgctcgatctcgcggacgaaacgccgagcgtcggcgcggtggtcggctgggtcgacctgaaggccgacgacgcaccggcgcggatcgcggcgtttgcgtccgcgccaaaggcgcgcggcttgcgaccgatgctgcaggatctgcccgacgacacgtggatcgacgatccgcggctggatcgcgcggtcgccgcgatgctcgagcacgggctgcgttttgatgcactggtgatgccgcgtcatctcgatgcgctgcatgcattcgcgcgacgccatccggatctgccgatcgtgatcgaccatggcgcgaagccgttcatcgagcgcggcgaatggcagccgtggctgtcggcgatgggccggcttgcgcgcctgccgaaccttcattgcaagctgtccggcctctggaccgaagcagggccgtcggctgggcccgacgccgtgcgcgcgcgcacgcggccgtatgtccacgcgctggccgagctgttcgggccgacgcgcctgatgtggggcagcgactggccggtgctgcggctggcgtcggcgtgcggcggctacggcgaatggctggccgcgtgcgaggacgattgcgcgcggttgctcggcgccgcggcgctggacggcctcttcggcggtaacgcacaccgcttctaccggatcgacaccgcacgccacgacgaatgaaccagaacgaaaggaacccgacatgctcagcgtgatttgcgaatccccggcgtgctgcgcgtgcagcagcgcgaactgcccgtacgcggcagcggcgaagtactgttgcgcgtgcaacgggtcggcatttgcggcaccgacctgcatatctttaccggcaaccagccgtacctcgactatccgcgcgtgatgggccatgagctttcggcggtcgtcgtcgaggcggaacccgagtcggggctcggcgtcggcgacgcggtgtacgtgatgccgtatctgtcgtgcgggcactgcatcgcctgtcggcacggcaacacgaattgctgcgtgaacatcaaggtgctcggcgtgcatcgcgacggcgcgctcgccgaatacctgagcgtgcctgcgcagttcgttcacaaggccgacggcatttcgctcgaccaggcggcgatgctggaattcctcgcgatcggcgcgcatgcggtgcggcgcgcggacgtccgcgccgggcagcgcgcgctggtcgtcggcgccgggccgatcggcatggccgcgatgatcttcgcgaagctgcgtggcgccgacgtcacatgcctcgacacgcgggcggatcgactggcgttttgccggcaacatctgacggttgatgcgaccgtggaggtgggcgaggatgacgcggcgcgtctcgcggcgttgacgaacggcgagtatttcgatgcggtgttcgacgccacaggcaacctcgatgcgatgaatcgcggtttcgaattcgtcgcgcatggcggcaaatacacgttgatctcgatcgtgcgcgggcacgtcgcctttcggatcccgaattccacaagcgggaagccacgctgctcgcgagccgcaatgcgacggccgaggatttcgcgacggtgctcgacgcgatgcgcgggggcgtattccggaccgcgcgctgaacacgcaccggatgcggctcgaagaggtgccggatgcgctgccgcgtttgctcgatgcggggcagaccgtcgtgaaggcgctcgtcgaatgctgatcgatcgaatccggcacgcggagcgcatgcgatgacgccgccgatcctccagttcggcacgagccgcttcctgctcgcgcacgtcgacttgttcgtctcgcaggcgctggacgacggcaacgcgatgggcggcatcggcatcgtgcagacgaccggcaatccggccagccgcgcccgcatcgacgcgctgcgcgccaccggtcgctatccggtgcggattcgcgggcgcgaccgcggcggcgtggtcgacgaagtcgtcgagtgccgcgccgtgcatcgcgcgtgggacgccgagcacgactgggcggagatacgcggtgccgcgatcgagaccgtacgcgtcatcgtgtcgaacaccggcgacgcagggtatcgcgccgatccacgcgacaccgtggacctgctggcccagcaggagcacgcaccgcaaggctttccggcgaagctgctcgcgctgctgcatgcgcgctggcaggtgcggcccgatgacggcgtctccatcctgccttgcgaactggtgacggacaacggcgacacgctgcgcgacatcgtgctggacctcgcgcgccagtggcggctgcccgacgcgttcgccgactatctgggcaaccgctgcgtgtgggtcaactcgctcgtcgaccgcatcgtgtccgagccgctccatccggtcggcgcgatcgcggagccctacgcgctgtgggcgatcgagcggcgtgccggcatggcgctgccgtgcacgcatgctcaggtcgtcgtcaccgacgatttgcgcagccacgagcgcctgaagctgttcttcctcaatctcgggcacagctggctcgcggagcagtggctcgcggcggggcgcgacacatcggaaacggtgcgggacgcgatgaacgatgcgcggttgcgcgacggtctcgaagccgtgtggcgcgatgaagtcgcgccggtattcgtggcgctgggcttgcgcgaaacggccgaacactacgtcgacagcgtgcgcgagcgctttctcaatccgtttctcgcgcatcgcatcgccgatatcgcggtcaaccatcgcgagaaggtcgcgcggcggatcgagccgctgctcgcgctcgccgattcgctggcgctggcggccgaacaaccgcggttgcggcaactcgtcgcccgctgcgaaccggtggccgcaacgacagggagaagaccatcgtgaagcaaccgaccatcgtgatccttcacggcaacgacaacgtcgccgtcgcactcgatgcgctggcgccggacgtgccgatcgacgtgcacggcgcaccgctgcggccggcggccgcgataccggccggccacaagatcgccaccacgccgatcgcgcgtggcgacgcgatcgtcaaatgcgggcagccgatcggcgtcgcgctgcgggacatcgccgcgggcgagcacgtgcacgtgcataacgtcgggatgcctgcgcggcatgcgcacgacgacgggccggcgggcgacacgcacgacgttccggccgatcgccgcgataccttcgacggattcgtgcgtcccgacggcagcgtggggacgcgcaactacgttggcgtgatcgcgagcgtcaactgttcggcgagtgtctgtcatgcgatcgccgatgcataccggcacggcgcgctcgacgcgttcggccatgtcgacggcgtcgtcgcgatcacccatcagagcggctgcggcatgtcggcgaccggcgacggcatcgaactgctgcgacgcacgctcgtcggttatgcgcgcaacccgaatttcgccggcgtgctgctcgtcggcctcggttgtgaggtcaaccaggtcggcgcgctcgcgcagcggctcgacgcggcggcacctggtaccgtgcgcacgctggtgatccaggacgaaggcggcgtgcgcgacaccgtggccaaaggcgtgtcgatcgtgcgcgagttgctggaggcggccgacggcgcgcgtcgcagcgccgtgccggcctcgcggctgacggtcggcctgcaatgcggcggctccgacggttactcgggcatcaccgcgaatccggcgctcggcgcggccgtcgatctgctggtccgcaacggcggcaccgcgattctgtccgagacgcccgagatctacggcgccgagcatctgctgatcacgcgagcggcgtcgcgcgacgtggccgagcgtctgctcggcaggttgcagtggtgggagcgttacgtcgccgacaacggcggcgaaatgaacaacaacccgtcgcccggcaacctcgccggcggcatcacgacgattctcgagaaatcgctcggcgctgtgtcgaagggcggccgctcgccgctgcgcgcggtctacgactatgcggagccggtgcggcaagcggggctcgtgttcatggatacgcccggttacgacccggtgtcggccaccgggcagatcgccggcggcgcgaatctcgtgtgcttcacgacgggccgcggttcggtgttcggctcgaagccggtgccgacgatcaagatcgcgacgacgaccggcctgtacgagcggatgcaatcggacatggatttcgacagcggcgggatcgtcgccggttcgctctcggtcggcgaagcgggcgagcggctgttccggctgatgctcgacgttgcctccggacgacgatcccgcagcgaggacaacggcatcggcgaacgcgagttcgtgccgtggctgcgcggcgcggtcatgtgacgcgaaaggcgacatgcgaccgcgtgcgcaatcggacagcgaaggagaagccgcgatggaaacccgcatgagcgagccggcgatcggcgaaatcggccgcgacgatcatctctccgacctggagaagggcttgctcggcgaagcgctgcgcttgctcgccgagacgcgcgcacaggcgctcgaactctgtgtcgaggtgagccggcggcagggcggcgggcgccgacctacgcgccggccatgcgcgcgtcgagccggaacaacgagacggcctcggcaagccggtttccctgttcctcgagcgacttcgaggcggcggctgcctgctcgacgagcgccgcattctgctgggtgacctcgtccatttgcgtaatggcgagattgacctgctcgatgccgcgactctgttcgctcgacgccgcggcgatttcgcccatgatgtcggtcacgcgcgagatcgcatgcgtgacctcgttcatcgtatcgcccgcgttgttcgcgatatgcgagccgtcctcgattttccggaccgattgcgagatcagctcgcgaatttccttcgcggcgctcgacgaacgctgcgcaagacttctgacttcgcttgccaccaccgcgaagccacggccctgttcgccggcgcgggcagcctccacggccgcgttgagcgcgaggatgttggtctggaacgcgatcccttcgatgatcccggtgatctcggcgatcttggcggagctcgcgctgatgtcggtcatcgtgtcgaccatcaggccgaccgccgagctgccgcgctgcgcgacctccgatgcgttgttggccaggccgctcgcctgttgcgcattgtcggcgttcaggcgcacggtggaggtcagttgctccatgctcgacgcggtttcctgcaacgacgcggcctgctgttcggtgcgggacgacaggtcctggttgccggacgcgatttcgccggcgccggtcgcgacgttgcccgatgcggtacggacttccgagatcaggcggatcaggttcgcctgcatgtcgcgcatcgaagccagtacgctgccggccggcgcggcgccggtcgtggcttcggcgccgagattgccggcggcgatatggccggcgatatcgctgagcacggcgggctccgtgcccagcgagcgcagcaggccgcgggtgatgacgaggcccgagagtgcggccgcggcggcggcggcgatgcagatcgcgatcagcatcaggcgtcgcgaggtataacggtcgtccgattccttcaccagttgatcggcccgcgcgcgcgagtacgtcgcatacgtgtcggtggccgcgacgagctgggccagcagcggtcggcactgttcgttgatcatcgtgatcgcctgatcgcgccggttgttcgccgccgcgtcgacgatggcgcgcgccacggggccgtactgcgcctcgaccgccccgatttgccgaaccagttcgcgcgccttgtcggatgcgccgctgccctcgcggaccgcattcgtcagttcgcccatcagcgcgccgacttcgtggtcggcctgcagcgccgcttccttctcgatgtccgcgtcgcgcgggctggccgcgaggacctggttgcgggcggcgatcgcgcgccggtcgaccgcgaagcgaatcttgtcggccaggttcgcgcgggcgttggtgccgttgacatagtcgtcgaatgccgcgttcgcgttgccgagcgagacgatgccgacgatggagacgagcacgaccgtacacgtaagaagtccgaaagccatgatcagcttcgtgcgaacggttaatcgtcgatcgttcatgggaggaatccggttgtggttatcaaatagatttcctgattaacggaatggtgaaagaaaggtttaggaccggcgctgcggggcaatcgtttgcgggttgcctgtcgtcaaaataaatccgaccgcgatccgcattcgtcacgctgagccggagaacggcgctgttttcgcccgccgtgccgttaaacggatcaggttcgccttgttcagcgatcccgtttcaatcacgcggtaacggagaccgaagtcatcatgctgtcatcaattcgcgcacggatacttgcgacgtgtgtcgccatcatcgcggcggcgctggtcggcgcgatgacgaacgcggccttcaagcacatcctgatagtgcgcgacgcgctcacggacgtctcgagcggcagcggcgatctgacgaagcgcctaccggccgacggcgcggacgaagccgcgcagatcgcgagagcgttcaacgcgttcgccgagaagatcagtacgatcctgcggcagatccgcgatttcagcacgtccgtgaacctcgcgagcgccgagatcgcacagggcaaccaggatctgtcggcccgcaccgaacacgcggcgtcgagcctgcaggaaacggccgccgcgctcgaggagatcgccggcacggcccgcaacccggccgatgcggcgagccaggtgaaccgtctggcggaatcggcgtcggacgtcgcgctgcggggcggcacggtcgtgcgcgacgtcgtgtcgacgatgaacgacatcacgcaggcttcggcggagatcgccaacatcgtcggcgtgatcgacggcatcgcgttccagaccaacattctcacgttgaacgccgccgtcgaggcggcccgcgcgaacgagcacggccgcgtcgcggtcgtcgccgggaagtgcgtgcgctcgcgcagcgcagcgcgcaggccgcgcgggaaatcaagcagctgatctactcgtcggtcgagaagatcgagggcggctccgggctcgtgcagacggccggtgcgacgatggacgaaatcgtcgacggcgtgcgcaacatcaccagcgtgatcgccgaaatcagcgtcgccgcgaaggagcagagcacggggctcgagcaggtgaatcaggcggtgtcgcagctcgacgatacgacgcagcagaacgcggcgctggtcgagcaatcggcggctgccgcgacgtcgctgcgcgagcaggcggcccggctcgcgcagacggtcggcgagttcaggctcgcggagcgcgcggtggcggcgtgacggttcgcgtgacggggccggcgggccccggtttcatgcggcgcggcgaagccagtccggctggcgcacccgccgacgacgggcgggatttcgttcgtatcctgcaccggtccgctgtacgtcgcccacgccgtggctgactgcgatcgatcacccgtggggaggccggtgttgctgccgttccgctcaggcaagcagcccgcgtgccgccagattcgcatacagcgcgcgcacgccgaaggtccacggcgcgatctccgtgcaaagccgcacggtgttgacgagtgcgccgagcgcgggcgtggagatcgtgacgcggtcgccgaggtgatgcgtgaatccgccgccgggcgcgtcgcgatcctggatcggcgagaacatcgtgccgaggaacagcatgaagccgtccggatattggtgatgcgcgccgcaggtctgcgcgacgaggtcggtcgggtcgcggctgatctcgcgcatatggctgatgccgtcgagtacgaagccgtcgtccgcgccttcgacgcgcagcgacacgctgcatgcccgcacgctgtcgagcgtgaagccgtcgtcgaacagccgcacgaacgggccgatcgcgcacgagccgttgttgtccttgcatttgccgagcagcagcgccgaacggccttcgatgtcgcgcaggttcacgtcgttgccgagcgtcgcgcccaccggcctgccgtcacgggcgaccgccagcacgatctccggttccgggttgttccacaccgacacgggcagcagccccacgtccgcgccgaagccgaccgccgacatcggctgcgccttggagaacacctccgcatccgggccgatgccgacttccatgtattgcgaccatgcgccgcggcgttcgagctccgccttcaggcgcagcgcggcttccgagcccggcacgatcttcgatagatcggtgccgatggtcgcggcgatggtgtcgcgaacctcccgcgctttggccggatcgccgcccgcctgttcctcgatcacgcgctcgatcaggctgaccgcaaaggtcacgccgcacgccttgatcgcctgcacgtcgcacggcgcgagcaggtgcgtcgcgcccggcgtgccgtccagcgcggcctgcaacaacggctcgatacggccgagcgattcgccggcagcggtgcgcgcgatggcgactgcatcggggcgatcgaacaggtcggcggtggtcggcacggtgcgtgtgatgtcgaacacttcgccgccgcgcacggcgacgacgctcgggcccgcgtgggcgccgtcgtgccgccagacgcggccgatcagcagcgcgtggtcgaggtcgtgcggcaggcaatcggaaacggaaggcgtatgcatggtcagctcggcaagagtcgggggcggtgggtcagtgcgaatggcgcgggttgccgcgctgctcgatcaccttcaggtacagcgtggccggttcgaggcagccgccggtggacagctggccgacgaaccggcgatagagttcctgccacggcgtttgcgcctgcggcacggtgaagctttcggtttcgcggcggcgcgcgagttcgtcctcgtcgacgagcacgtcgacgctgcggcgattcaggtccacgcgcacgcgatcgttcgtgcgcagcagcgcgaggccgccgccgaccgcggcttccggcgacatgttcaggatcgacgggctggccgatgtgccgctctggcgtccgtcacccatgcacggcagcgacgtcacgccgcgcttcaccagttcggcaggcggcgccatgttcacgacttcggaactgcccgggtagccgaccgtgccgcagccgcggatcacgaggatgcagcgctcgtcgatgttcagcgcgggatcgttgatgcgcgcgtgatagtcctcggggccgtcgaacacgatcgcgcgtgcctcgaacgtattctccgcgcccggctcggacaggtaggtgcggcggaacgcgtcgcccaccaccgacatcttcatgatcgcgctgtcgaagaagttgcccgacagcaccatgaagccggcgccatgcttgagcggcgcatcgggcgtgcggatcacgtcgcggtcggcgtcctgcgcggtgtcggcgatctcgccgatcgcgcggcccgatacggtcaggcagtcgcgccgcagcagcccggccgaatcgagctggcgcagcacggcgggcacgccgccggcgcggtggaagctctcgccgaggtagtcgccggccggcatgcagttgacaagcagcggcaccgattcacccaggcgctgccagtcgtccaggctcagttcgacgcccatgtggcgcgcaatcgcgatcaggtgcggcgggcagttggtcgatgcgcccagcgcggacgcgacgacgatcgcattctcgaatgccgcgcgcgtcatgattgtcgacgggcgcaggtcttcccgaacgagctcgaccgcgcgcttgccggtcgcgtaagccatctggccgcgctcgcgataggcggcgggaatgctcgcgcagccgggcagcgacatgcccagcgcctcggcgaggctgttcatcgacagcgcggtgcccatggtgttgcaatggccgatcgacggcgacgaggccgtggtcagctgcatgaagccttcgtagtcgatctcgcccgccgtgagcaggttgcgcgcatgccagatcaccgtgcccgagccgacccgcttgccctcgtgccagccgtcgagcatcgggccgcccgacagcacgatcgcgggcatgtcgacggtggcggccgccatcaggcacgcgggcgtggtcttgtcgcagccggtcgtcagcaccacaccgtccagcggaaagccgtgcagcacttccaccagcccgaggtacgcgagattgcggtcgagcgcggcggtgggccggcggctttgctcggcgagcggatgaacggggaactccatcggaatgccgcccgcgtcgcggatgcccgccttggtgcgttcggccagctcgatgtgatggcggttgcacggcgcgaggtcgctgcccgtctgcgcgatgccgataatggggcggcccgactgcagttcctcgcgcgtcaacccgtagttcatgaagcgctcgacatagagtgccgtcatgtccgcgtgcgcggggtcgtcgaaccattcctggctgcgcaggcggcgagggtgtgtgacatggcaggctgtctcctgaggggcctttttcattttgcatgccggatggtaccggtaacatcgtttggatgttagcacgggtttttgcgcagcggaagggatttcgtgcgcatgtggcgaaggtgggggcagggggcggtacgaagccgcgcgcgtggcggtcgggatgcgcgcggccgtcggcttgtcaggcgctttcccgcgcgatgatcgtgtagtcgatacggatgcttttcgattcggttcgctcgccgccgtcacgcgcttgcagcgccgccagcaacgcttcgcccgtgcgcagcccgatgccgtacgcgtcgaccgatacggtcgtgatggtcggatggcagcatgtcgccacttcgaagttcccgaagccggccacggcgatatcggccggcacggcgagcccgcgccggtgacactccatgatcgcgccgaacgccgacatgtcgctcacgcacatcaccgcgtcggtatccggccattgctccagcagcgcagccatcgccggcccgccgtggctcatcgtgatcggcgattcgcccagccgcacgacgcgcggttcgcccagcccctgtgccttgatctccgcctggtagcccttgagccggtccaggccgcggcgatccagttcgctcgcgccgaccagaaagccgatgcgccggtaaccgcgctcggccaggtggcgcaccatcgcacgggcggcgcgcacgttcgagaagccgacggcggtgtcgatcgggcgcgtgggcaggtcccacatctcgaccactggaatcgccgagcgctccaataccttgcgcgtcgcatcggtgtgctgcgaccccgtcagcgcgatgcagcgcggctggtgtcgcagcatcgaccggacgagccgttcttcccgttcgaggtcgtagtcggtatcgccgagcagcagttgcaaaccatgcggctcgagtgcatcggtcaggccgcgcacggtgtccgagaagttggaactcgacagcgacggcaccagcaccgcgacgaattccgagcgccccgacgacagcgcaccggcagcggcatccgccacgtagccgagctggtcgatggcctcgcagacccgtgcgcgcgtctcggcggccacgctgtggccggcgagcacgcgcgacaccgtcatcttcgatacgccggcgaggcgcgctacgtcggacatgcggggcggcccggcgggccggacggcggtgggactgggcatcggaatcgcgatcgggaggaggcaggaaaggctacatcataccggtgcggcataccgcgcaggcggggcgcggcgtgcccgccgcggtgagagtcgcactagggaaaccacgcgtccggcggcgcttgtacacgcgtgtcgccgcatgctactgtcgaatgtgttaccggtatcagcttgccgatcgctcccgtcgcctcgtcggcttttttgggcacctgatgttatcggtaacatcgatgcgcgcagcgcacgcgacggtacgaagaagatcgacacaatcaggagacagaccgatgccatcccttacgcaggccgctgccgcaccggccgcggccgactcgtccgaagacgccctttaccgcaaggtcatgcggcgcatcctgccgttgctgctgctctgttacgtcgtggcctacctggaccgcgtcaacgtgggcttcgcgaagctgcagatgctcgacgacctgaacctgagcgacggcgtctatgcgctcggcgccagcatcttcttctggggctatttcctgttcgagatgcccagcaacctgctgttgcaccgctacggcgcgcgcttctggattgcgcggatcatgatcacgtggggcatcgtgtcgtcgtcgatggcgttcatcgtgccgctcgcgcagttcttccacgtgcagacgaccacgatgttctacacgctgcgcttcctgctggggctgtgcgaagcgggtttttcccgggcgtcatcctgtacctgaactactggttcccggcgcggcgccagagcgtggcgatgtcgggcttcctggtcgcgatcccgctgagcctgacgctcggcagcgtgctgtccggctggctgatggagcagacgcacggcctgtcgggcatgagcggctggcaatggatgctgctgctcgaagggctgccgtcgatcgtggtggcgttcatcgtgctggcctgcctcggcgacggcccgcagacggcgaagtggctgtccgccgacgaaaaggcggtgctgtcgcgcaacctcgaatccgaggccgcgcacaagtcgcacagcatcggcgccgcgctgcgcagcccgcgcgtctggttgctcaccttcattctgctgacgttcaataccggtttctacgggctggccttctggctgccgtcgatcatccgcgcgtcgggcgtgcacagctcgctgcacatcggcgtgctgacggccattccgtacctgacggcgatcttcgcgatggtgtggaacgcgtcgcactcgcgcaagaccggcgaacgccgcctgcatgcggcgattcccgcgctgatcggcggcgtcttcctgatcctgagcgcggcgttcgcgcacaacgtggcgctgttgatcgtattcctgaccattgccacctgcggcatcctcgcgctgatgccgatctactggacctttccggggcagatcctgtccggcacggccgcggccgccggcatcgcactgatcaactcggtggggaacctgtccggcttcacgggctcgatgatcaccggcgtcgccaagcagatgaccggcaacatcaacaacgggacttatgcgctgggcgcttgcctgctggtcagctgcgtgttgatcgcgtcgattccgcgcgatatcctgcggccgccggtggggcggtagggcgttcgcgcgacgttacgtccggccggggctggggcatcgcgccgcctcggcgccggatgcatcacgtcacgcggatcgatcttgtgtgagtttgctcgaccaccacacgcggaattccggctacttccagccagggatgcccggcgcgcgactctgctttctcgtgagcggccgtcatgcgtcctccagtgcgaagcgcaccttgtccccgagcgtgcgcaaccggtcgaccggttcgttcgagaacacgaaacggacgtactgctcgccgtgggcgacgccccatccggtcatggccgtcgcacatacgccgtggcgcagcaaccgctccgacatctgcgatccggtcagaccgaaatcggcgacgcgcagcagcatcgaccagccgcccgccggcatgccgaacggagtcccgacagttcggcggcgaccgtatcccgccgtctctccagttcgctcacgtagccaggcagatcggatgcggaatgttcgagcgcaaccgccgcggcctcctgggctatgccgaccggtaccacgacattggcgagcgacacggccaccagatccggaatcagccattccggcgcgacgatccagccgacccgccagccgatcatgcgcaactctttcgacgccgcgccgaccgtgaccgtacgctcggccatgccgggcaggccggcgggatggatgaccgtacgtccatcgaaaagcagccgttccatcgcgctgtcgaggatcagcagcagatcgttctgcacacacaggctcgcgatcacttgccagtcggacgcatcgaagaagccgcccgaaggcatcgacggcgacatcagcagcatggcccgcgttttcggaccgattgctgcccgcagtgccgcctggtccagcttccattcgctgcccggcgtgaaggtgaacgggacttgcttaggcacgccgcccgccaggcggatgcggttcagcagaccggcgtacgtcggatcggtgacgatgacttcgtcgcccgtctcgacggtggcgagcagcgtattcagaatgccggagagtccacccgccgacaccaccacctggtcggccgtgaagcgctgccccgaaagcgccgacacgtgggcggcagcgctcgcgcgcagccgatcctgaccgacgaagggcaaataggagttggccgagtctcgctggatggcttctcgggtgaaggcgagcgattccgaagtgggggaggtcggtgtcgagattttcgagtcgcaaaggtcgacgtcggcatgatcggcgatcgaccccatgcgatcgacgccgatgccggcaatgtgctgcagacggacagggcggtggcggtgcatcggacctccgattttgttacaattttatagataatatatgcatggtggtcgggatgaactttgaagtcaaggaggagcgctcgctggccgatcggatcgctatcgcattggcggaccgcatcatctcgggcgtcatcgcgccggggagtggctgcgtcaggaccacatcgcggcagagttcggcgcgagtcatgtgccggtacgcgaggcgttcagacggctggaagcgcaggggttggccgtggtggaaccgcgacgaggcgtgcgggcggcgccgctcgagccggcggacgtgcttgaaatggccaagatgcgtgcggctttcgaggcgctggcgctgcgcgaggcgattcccgcgctcgatgcacgggcgctggaggagctcgatgcgatcctcgatcaggaggccgcggcgcgtggcatcgccgtgctgggcacgctgaatctgaggtttcatcgggcgttgaccgcgccgtgcgggatgccgcggctcgtcgccgcgattggcgacatgcatcgggccagttcacggcatctgtatgcgacgtggcagcaactcgactggcaggatcgctcgaacgacgaacatcgggacatcgttcgggcgatacgtgaggggaatgtggacgcggcgtgtgcggcgctgtccgcgcatattctggctgcggggatgcgctggcacaggcgttgggtgggcggtaggaatgtgggtcaggccggggcattgaccggtgcggaaggctggtatgggaaatggctggcgttttctctggggtagctatagtcaaacgcgtcgggcggcatccggccagatgcggtcagtcgacaggccagcgcagatcgtcgacgagttgtttgaaccggagagaattaccttgggaataaacgaagacatctgggatatacgcggctgcggcattgtacgctgcggagttttaccatttccggcgccgagtcccgctgctgtagcgaaagcgttcgagttgcgcgatgacgacgcctgttaccgcgaaatcgatgaaagtgaggcacgttggcttcacgtcacaactagaattgaagtgcgcgacgatccgacgacggatcggcatcggtcacatttccggaagagaaaccgatagaaaaagcccgcacatgcggtaatgccgttcagttaaggcactttgaggtgccgaacggagtaacgctgagacaactgtttgactgcttttgcggacggacatcctgttgcggctcgcatgcatgaatctgatgataaataccgcctgtggcgattttcaggctcgccgattacgacgaatggttgcacgtaaggatcgtcaatgccgcgtgtagtgccacaactcgatcccaccgacgagatgtccacggcacccgcgccaaagataatgagaatatcgagtggatcggcgagagttctttcgcggtatttggcgtgatcatccgcataaaccccttgcgcctacatttaaatcctgaaagtaatattcacccgaaaaccttacgctttgcgatttagaatgtgaaagcacaaatactccaaaatgcagtagtaccaacctatattatcatcgttcttcattgattctatattagcccagtcatttttattggaaaaactccagcgccaaacccatttcagctcgttatcggccggccactcttttataccgtgcttccttgcatataaagttatttctgaatatttttaatgtctctgcgcataatcgccccggcaatatccctggaattaggtagggcgatttctgatatattattccacgtattttccacatcttcttcgcttgcgcaaaaatatactgccgaaaagcaaagttcgttgcattgggtggcaatgcctcacccttcacattgaatttcactgtttccggcggattattatcggggctaagcggcaaattaaatccagtttcctccaagaactcgcgcctagcaccgtcctcgatgttaggttcctctagcttgcctccaggcaatgcatattctccaggaccgctatttatcgtccacccaagcgcattgaccttccccgtcggcttgggtataatatgacttcacctgctttttagccattagaaacgtaccgctcttatcgtataagacggcataaacagaagccatgatgcctccacaattttattttgcgcacgatgccgttcggcattgattcgattgccgaacaatcgatgttgcgagatttgagcgatctatttccgctctgccgatggcgggctacgcccgccatcagtgtccccaacagttgaggttcacgaaatttaagctcagccctgcactgtcagtaccttccatgtgccgctaccgccgtcacgattggcgagacgcgaacccgtgaccaaatattggaagggtttattattacctgcgccgttggtgtccagaacgcctgccaaattattaaaattagccaccaaaattatgttgtcctcgtaatttaagccgacatctttgccgcttttttggtggtaataatgatggtccagttgatagtaaccagagcatcatccgtatcagtggttgttgccacggggtagccggaatcgctcggggcatagctgttgaataatgccaaattgccaccatcactagcatttaccagggtaatcgtatcgccactataaacggagctgccgtcgccagaggattccaccaaccctattgtccattgcgtttcatttacataatcgctaaatgacttgtatgttccaatggggtccagagcactggttatactcgtagtctgtttggtattgatgccgagatagctgggattaccttcgcctccgtaaagattgctaatgcggatattcttgccatattgcacataatttgacattttcgttctccggttttcaatttgacgacgaatgcgacctagccatcatgattttggcaaaaattcaaatccgcttgaatttgcagcgcaaaataagaaagatcgcgcaaaaatatagaagctcgcgcgcggaagatcaattacactcaattacacgaaataaatataaattaagaaataaaataactcgccattcagcaataacgagtaccccacatagcacgcaccaaaaacaaccgggtggcgtgttgccgcacaccccgcggtcgccctgctcaagggtctgcgcgagccgccgcaagatcgcagcggtcgcaggcgacggtgtgttgtcgacctgccgagcacgcgcggtatcgctgcgcgtaaattccttgagtgtgaagtgcggtgtgagttgcatgtggcgatccaaactgcgatccacgaacgacgtccctcagagtaaatcggtggagcgcttgaggtgcggtaaggaagtggatcagcgcaggtcggccggcatttgccagggcagcagcgcgtcgtagtcgtcgacggtggtcgccagcgggaggcgttggaacagccaggtgagatagcgatacgggtcgatgccgttggccttgcaggtctcgacgagtgagtacagattggcctcgcgttaggggacgtggcgttgctggatcgacgtattaggccgggcggtcgcttgcgtcgcgtcgacgccggggctatccggatcatagatgtggctcacgagcgccgtaatgaggaaagtcgctcgtgacaagtgcatggcgtgcacgtaaccgatgatcaacaacttgggtgcatgcgcaacaataaacctctcgtcaaaaggacggggtgcgactttaatgcctgttttccagggtggggaggctgtcgacattgagccgtggtgcacgcccatgtcgcgcttcaactccatcgtttggaattcagcgcacgtcgacgaaatacctcgccagcgacctgccgctgctcacttcctcagcttgacgttcgccgccccgcgttagcggaatcattggacacgattagcgctcgaacggacactattagcagaatctacgaacttcaacacccgtgccccggcgcatcgccacgggcgcgtcggccgttggcccgcgcctgtccgcgcgggaaatcgacgtcctgcgcgcaatctcccgcggcgcgagtaacaagcaggtcgcgcaggcgctcgcgatgagtccgagcacggtgcgcacccatgtcgagaaggcgttccgcaagctcgaatgttcgacgcgcgccgcggcgaccctcaaggcgtcggcgctggggctgctctgacgcgctccgcgacgcggattcgctttcgtgtgtgcgcggacggcccgtcgggccggcgcgacctttgacgctccgcctgtccggtggcttatcccgcgtatcgaagatggcggttgcaccattcaagtcgaccagtcgttgatccgttccctgcgatccgaggctgtcgcgtcggtgtcggcccaaccgtaccccaacgtcgcgattgcgaagtagacggcaccgacggcttcgcaggaaagcagcgcgccggccagcgccattcgcgctccacccgagaccatttgcgccggcgcgtcggcgtgtttcccgcgatgcactgcggtgccgatccgaaacaggcccgacacgatagcgagcacgccgaacgcacgcggcaggccgctcgccaatgcgacgatgaagatctgacgtcccgacattgcagtgatcctcccggtccggtatcgcgtgacggttgcctatcctgacacccgatcgttcgcggcgccatcggacaagtgaccgatggcgccggccgaaaccgatgcatggcggcgcgcgatcgccgctacgacacgcgcgggaacacgtccgtgatgagccgatcgggttcgatgtcggtgaacgcatcgatatctgccatgacgtctgccgtctccgcggacgcggacgcagcgtccagcgccgcactgtccttgaaacggcacatcgccacgacgatcagttcgctgtcctcacgtgctggaaagaaagcgtcgatagcgtcgagcccgtacggcttccaggatttttccaccagcggaatgtgttgctcgacgtagtaacgggcatcgaatcgcgtgcccgcggctcggcgataggagacgatgaaatacacgaagaacctccaggtcggactgacgcggcgatgaatgtcggtacgggaaaatacgggcaaatacaaacgatcacggtcgttcgcgttcggggccgaagcccggacgcgcggcggcccgcatcgacgtgtgcgcggcgcccgcccgtgcaagcgagatgcccagcgcggcgcccacggcgaggaacaccgagatcgacagcagtgcgacgatgaacgcatgcgcgatggccgccggatcgtggcgcgtgccgagcgtcgtatagaaaatgccgccgatgatcgccacgctcagcgacgtgctgacctgcagcgtcgagctggcgatgccggcgatcatgccggacagcgccggtgcgacgcgccccgtcaccatgcgcatgagcgtcggcagcgcgagaccttgtccgaaaccgatgacgaagagcacgacggcgagcggcgcggcagcgagcggcatcccgatcggcgtggcatcgatcaaccacgcgaggccgacgagcccgacgatctccagactcatgccgaacggattgacgtaagcgccgatgacacgcgcggaggcaggcgtcgacaacgggccgagcaggaacccgacgccgaacggcaagaacacgaggcccgcgctcagtgcgtcgacgtgcaacgcattctgcagatacaccgagaacagcaggaagaacgcgccgatcgagtacagcagcagtgcgatcagcaacgcgcggccgagccccggtgcgcgcagcgcgccggatcgagcagcggtgcgccgccgcggcggccgagccggcgctcgtagcgccagaagaacccggcgagggccggcaccgcgagcagcgacacccatgcccatacgggccagcctgcttcgcgcccctcgatcagcggcacgatcagcgcgcccagcgtcagcatcgacagcgcggtgccgccgaggtcgagcttgcgcgcatgctgcgcacgcgtttccttcaacagcggaatcccgaacaggacgaccagaatcgccagcggcaggttgacgaggaagatcgtgcgccagcccagattcaacagattcagcgagatcaggatcccgcccagcgcctgcccgaccacggcggcgaggccgaataccgcgccgtacaagctgagcgcgagcggcttttccgcttcgggaagatcgcctggatcgaagcgagcgcctgcggcgccatgatcgcggccgtcacgccctgcaacgcgcggccgacgatgagcgtccacggcgaactggcgaaaccgcacagcgtcgaggcgatcgcaaagccgatcaacccgaggaaaaacacgcggccgcggccgaacaggtcgcccaatcgcccgccggtgatcagcgtcaccgcgtacaggcccgcatacgatgaaatgacgagttgctcggccgacgacgaggcgcccagttccgcgcggatcgacggcagcgcgacgttgacgatgaagaaatccagcggcggcaggaacgcgccgacgagcaggaccgcaaacatcgcccagcggcgcgggtcgggtgatacggggtcattccgtgacatggacggttctccatacggaaccaatcggttccaaattgggtaaaaatatcagtcgaggatgcgcatcgtgcggtcgaccagcgcgagcatgtcctgctccgacacgccggttttgcccagcacgcgcatgccctcgatctggcagaccagcaaacgcgccagcacctgttcgtcctgttcggcgatctcgccgctcgcctggccacggacgatcgcaccggcatagagctgttgcagccgccggaacatgcgcccggtgcgctccgcgacatccgcgtcgcgcgcggccagttccgtggtcatcgcgaccgcgagacatccgcgccggcccgcctcgccgacggacaggcgcgcatagcgcagcagcgaatcgcgaatcgcatccttgacggcgccgggttgcgacagaatgtccgcggtcgccttgagcccgtcggccatgtacaggtcgagcgccgccagcagcagcgccttcttgtcgccgaacgccttgtacaggctaccgcgcgacaggccggtgccggccatcaggtcgggcagggacgcgccttcgtatccgcggtcccagaaaacgtccatcgcgtcgcgcgcggcatcgccaagttcgaattcgcgtgggcggcccacgccagccggatttgccattgatcgatgtcgcaaacgatgcggtgccaaaagttggatgcattatatggaccgatcggttccgatgtcaacgcatgcctgtcgaccgggcgcggcgagggccgcctcgcggacggcccggattcatccgatcagtcgagcccgccctggcacaggtacttgatcgacagataatcgtcgagcccgtagcgcgagccttcgcgaccataacctgattccttcacgccgccgaacggtgcggcctcgctcgcgagcgcgccttcgttgatcccgacgatgcccgtttcgagccgcgccgacacgcgcgcgatgcgccgcacgtcctgcgtgtagaaatacgcggcgagcccgaacggcgtgtcgtttgcggcgccgacggcttcgtcctcggtatcgaaacgaaacagcgccgcgaccgggccgaacgtttcctcgcaggtcagctgcatgtcggcggtggcgtcggcgagcaccgtcggtgcgaaatagttggggccgagttcggccagacgcttgccgccggcgagcacgcgcgcgccgcgttcgacggcgtcgccgacgtggcgggcaatcttgtccaccgcacgcgcgttgatcatcgggccgatctgcgcggccgggtcggtcgccggcgcgaccttcagcgcggcgacgcgcgacgcgagcttcgcggcgaatgcgtcgtagatgccggcctgcacgtagacgcgattcggcgacacgcacgtctgcccgccgttgcggaacttggcggccatcagcccgtcgaccgcggcgtcgagttcggcgtcgtcgaagacgatgaacggcgcgttgccgccgagctccagcgacagcttcttcaacgtcgccgccgattcgcgcgccagcagcttgccgacaggcgtcgagccggtgaacgtgatcttgcgcacgcggccgtcggcgagccagtcggccaccgcatcgatgccacgttcgcgcgacgcggcgatcaggttcagcacccgggcggcacgccggcttcctgcgcgagaaacgcgagcgcgagcgcggtcagcggcgtgtcctccgccggcttcgcgaccaccgtgcagccggccgcgagggcgggcgcgatcttgcgcgcgatcatcgcgagcgggaagttccacggcgtgatcgcggcgacgatgccgatcggctccttcaccgcgctcagccgcttgccgcgctgctgctgcggaatcaggtcgccatacgtgcgtgtcgcttcctcggcgaaccacagcacgtacgacgcgccgtatgcgacctcaccgcgcgcttccgcgagcggtttgccctgttcgcgcgacatcagtttcgcgagatcgtcggtatgcgcaacgatcgcggcatgccatgcgcgcaggatcgccgcccgttcgcgggcgggtgtcgcgcgccatgcgggcagcgcgcgcgcggccgcgtccgtcgcggcgcgtgcgtcggcggcgccgctgtcgggtgcgtgcgcgacgatgtcgagcgtcgcgggatcgacgacgtcgaagcgacggccgtcgagcgcgtcgcgccacgttccgtcgatcaggttggcggtgcgaacgagttcggttcgggacagcgtaagcggcatgacaggtccttggaggaagcgggtcggcgaaggcgcgggcgcgcgactaccccgcgcggacagcacgtagccgcgttcggggttgccgcacgccgtccgtcagtgacgttcgccgaacagcgattcgagcgggtagtgccgtttgacgaacggcgatttgatgatcacgtaactgaaatacttctcgatgccgatgttctgctcgagcagcccttcgacgatcgtctggtaatggctgacgctgcgcgtgatgaacttcagcagatagtcgtagccgccgctcgcgaggtggcattcgacaatctcgtcgacgttgcggatcgccgcgacgaagcggtcgaagtcctcgcgccggtggtcggccagcgtgacctcggtgaacacaacctgcacgtcgccgagcttctcgagctggatgtgcgcgccgtagccgccgatgtagccggccttctcgagccgcttcacgcggatcaggcaggggctcggcgacagcccgaccgcgtccgccagctcgacgttggtcatgcggccgcgcttctgcaactgggagaggatgcgcaggtcgatgcgatccagcttgctgtccgtcatgttcacgtgagtcggaaaaatggaatgtccggttactttagagtcgaacgatggccgccacaagcccggctttcccttggccggtcaggccggctgcgcgtgcgcggcgtcgagggcgcgctgcacgcccggatcggccagcacgtcgtcgagcgtcttgcgcacgcgttcgaacatcaggtcgaactcgcccgcggtgaagctcagcgccggcgcgaagccgagcacgccgtcgccgaacgcgcgaaacaccacgccgttcgcgtaggccgccgccgcgatcttgtccggcacgttcagtgccgcgtcgaagcgcgtcttgtgcgccttgtcggcgaccagctcgagtgcgccgagcaggccggccgaacgcgcgtcgccgacgagcggatgcgcgcgcagcgcatcgagccccgccgcgaagcgcggcgtcagcgcctggccgttcgcgagcagcccgccttcgtgatagagcttcagcacctcgaggccgatcgccgcgctgaccgggtgcgcggaatacgtatggccgtgcccgaccacggccgactccgcacggctgcccgcgatcccttcgtagatttcgtcggacatcagcactgcgcccatcggcgcatagccggccgtcagccccttcgcgacggtcatcaggtccggatcgacctgttcggtctcgcacgcgaacagcgggcccgtgcgaccgaagccggtgatcacctcgtcggcgacgaacaggatgccgaggcgccggcacgcgtcgcgcatcgccttcagccagccggccggcggcacgatcacgccgccggaaccctgcacgggttcgcagaagaacgcggcgacgttgtcggcgccgagttcggcaaccttggcttcagcgcggccaccgacgcggcgatcagcgcctgcggatcgccgccgagcggatggcggtacgggtagggcgacgggatgtggtgctggtccgcgcgcggcaggtcgaaatggcggtggaacgcgggcagcgcggtgaggcccgcgccgatcgacgacgagccgtgatagccgcgctcgagcgcaatcatctgcttcttcgacgggcggcctgtcgcgttgaaatagtgcgtgatgaagcgcaccgcggaatcgatcgcgtccgagccgccgagcgtgaagtacacgcggttcagcgacggcggcgcgagcgccgcgagccgttcggcgagctcgatcgcgggctgcgagccgaaatggaaatagccggtcgcgtagggcagtttcgccatctggtcggcggcggccttcacgatgctgtcgcggccgtagccgacgttgacgcaccacaggcccgagaacgcatcgagcagcgtatggccgtcggcgtcgcgcaggaacacgccgtcggcggattcgagcatggtgacgccgcgcgcctcgtgcgcacgatagttgacgacggggtggatcaggtgttgacgatcagcttcgatcagcgcggcgtggttcatggcagggcgggactctcgtcgggtgtcagcgatgagttcatgctaccgggcgagccatcctcatgcgttttcaatttgcagtctgaaacatacgaacgcggcgtttgtgcggggcgcttcggcattttctgctgcgcgccccgctgggcccggcgcacgcgtcagtaaccgcgcgcgcgatcgacgacgccgatcatcggctgccccgcgcgatggcgcgcgaggttcgcgagcacggcctcgaccgcggtgtccggccgcgtcgcgctcgcgatgtgcggcgtgatccggatgcgcgggtgcgtccagaacggatggccggccggcaacggttcggggtccgtcacatcgaggatcgcgctgtcgagccggccgctcgcgagccccgcgagcagcgcggcttcgtcgagctgcgggccgcgcccgacctgcacgagcgacgcgcccgccggcagcgcatcgaacacgcgcgcgccgagcagcccgcgcgtgccgtcggtgagcggaagcaggcagatcaggatgtcggtgcgggcgaggaacgcgtcgagtgccgcgtcgcccgcgtagcagtcgatgccgtcgagcgtgcgcggcgtgcggctccagccggcgcacgggaagccgaagcggcgcagcgtatcgagcacggcctggccgagcgtgccgagcccgagcacgccgacgcgccgcgacgcggccgcgcgcaccggctgctcgcgccacacttgcgcgcgctgctgggccgcgtagtcgagcaggtcgcggtggatcgtcagcacggcctgcgtcacgtattcgaccatgccttcgacgatgccgggctcgatcatccgcacgaccgggatatgcgcaggcacgcgcgacaggtcgaactgatcgatgccggcgccgaccgagaacacgacttcgagattcggcagcagcgtggccggatcgtcgggcggctgccacgcggcgagataacggacggcttcaggatcgccgaggtccggccagatccggaacggaagctcgggcgcctgttgcgcgaagcgctgtgcccattgcgcaccgcgcaccgggtcggccttgtagagaaagctcatcgtcggtaccgctcaaccaagggcctggttcacgatcgcgaacgcgcgcagcgccgggtcgcgagcgggcgtcgcgccgcgcgccatggcgacgacggtatcgacgcgcggcagaccgagccctgcagccagtcggacagcccgctgtcgcccggtacgtcgagccgcacgaacttcccttcgtgcagcgcgagccagtggctgatcagcgcctgcgcgcgctgcgcgtccggcgcgaccaccgggccgatcgcatggccgcggccgaagcggcggaacagcgcgaagccgagcagttcgccgtcgcgatcgagcgcgatgccgttcgcgacgccgagcagcgcctcgatcacctcgtcgcgccgataacccgcggcccgcgaggcgagcgcggcaagccgcgggccgtcgtttgcgccgatgggccgcaggcgctcgccgggcggcagcgatatcagcggcggctggaaggcggcaccctggtgctgatcgatcgtatcgatcacctcgaacccgaatttcgcgtacagcggctcgccggccggcgtcgcgtgcagaaaatggttcgcgtgccgaagctgtcgaccacgcgggtgagcagttcgcgcccgatgccgcggccctggtgctcgggcgacacgatgaccatgccgagcgacgcgtgcgcttcgccgaagcgccagccgagcgcggtaccgacgatgccggtttcgtcctcggcgacgaagccgtcgccgagctggagcacgaagcgccagtcgtcgagccggtgcggccacttgactgcttccgacagacgatgcgcggcgggcaggtcggtttcggcgaaccgacgataaataagcgtgcgggaagggttgagatcggacacgctggactccggatgggtaggaatgacatatcgactctgccagcgacaccgcggcacggataggatgattcgcctgttttccggcgacggcgggcggccgtgcaagatcgacgcaaaccggctcgatcggcgcgtgcgaacgcgcggatcgtgccgccgcggcccgtcaatccgacagcgcctgctgtgggaacggcactacgatgaaaacaccggtgtcgcggccgcttgccggcgcgtcgccccgccggtgcggcgggaccgcgccggcaagcgccgcagatcgtgctgcccgcgccgcgcaacacgcggcgattctgcgttttgggcggcgtcgaacgacgtgcgccgggtttttgccttgattcaatttcgtaccacccagcccgtccccggccctgccggggcttcacaccgacaggacgtcaccatgatccaatttgaaccgaagtacatcacgttcgactgctacggcacgctgacccgcttccagatggcggacctggcgcgcgagatctacgcggaccggctctcgccggtcgcgatggaggatttcgtgcgtgcgttcgccgcttaccggctcgacgaggtgctcggcgcgtggaagccgtaccgcgacgtcgtcgtcaacgcgatccggcgcacctgcgcgcgagtcggcgtgaagttcgacgaggccgaggccgagcgcttctatcatgcggtgccgacgtggggcccgcatccggacgtgccggcgggcctgtcgcggctcgcgacgaagtacaagctcgtgatcctgtcgaacgcgatggacgagcagatcatgagcaacgtcgacaagctcggcgcgccgttccatgcagtgttcaccgcgcagcaggcccagtcgtacaagccgcggatgcagggcttcgagtacatgttcggcaagctcggctgcaagcccgaggacgtgctgcacgtgtcgtcgagcctgcgctacgacctgatgacggccgaggatctgggcatcaagcacaaggcgttcgtcaatcgcggccacgagccgggcacgccgttctacaactattacgaagtgtcggatatcggccatctcgcgacgcagctcggcctgtaagccgccggggccggccgatccatcgcgcgacgggacgcggccgcgatgccggcgcgccccgtcacgcgctcgatcagcgtacgaaacgagggtaattaccgatatcgagtcgttcaaggcggggccgccccggccgatatatgtaccgaacggttaatatttcgaggcccccgcatgaagttgtccaccaaactgctgatgctcgtcgccgcggcgctgctcggcgtcgtcctgctcgccgcgttgtcgctgcacacgctgcgcgacgcgctgatcgacagccgccgcgaagaggtcgtcattctgctgaccaaggccgagcatctggtcgattcgtatcgcgcgctgcagacgagcggcacgctcacgcaggagcaggcgcagcagcaggccaaggccgcgctggccgcgctcaacgcgaattcgaagagctacttctgggtcacgacgtccgacggcgtcaacctcgtgcacccgaacgcgaaattcatcggcacgcgcgcgaaaggcaaccgcacgaccagcggcatgaccgacagcgaggcgtaccgcgcggggatggcgcaggcgcatttcgcgctcgtcgacgtgctgatcaagcgtagcccggacgcggacctggagccgaagctgcagggcgtggtcgcgattccggactggaactggtggatcggcaccggatttttctacgacgacatcaacgcggcgtttgcccggctcgcgatggcgctcggcgccgtcgcgctcgtcatcgccgcggcgctcgcggccatcgcctggggcgtgctgcgcagcgtccggcgcacgctgggcggcgagcccgcgcatgcgacgcagatcgccgcccgcatcgcggccggcgaactggacgtgcagttcgatacggcgcacgccgcgcccggcagcctgctcgtcgcgctgggcgacatgaaggcgcggctgaccgacaccatcgccgagatccagaccacgacccactcgatcgccaccggcaccggcgaaatcgcgcaaggcaacctggatctgtcgcagcgcacggagcagcaggccgcgtcgctgcaggaaacggcggcgagcatggagcagatcacgtccacggtcaaacagaacgccgacaatgcgcgccaggcgaatgcgctcgtggcccaggccaaggatgcgaccgaactcggcggcgccgccgtgcaggcggtcgtcgaaacgatgcggcagatctcggatgggtcggtgcggatcgccgacattaccgtcgtgatcgaaagcatcgcattccagaccaacattctcgcgctcaacgccgcggtggaagccgcgcgggccggcgaggaggggcgcgggttcgccgtcgtcgcgtcggaagtccgctcgctcgcgcaacgcagcgccgcggccgcgaaggacatcaagggcttgatcgacgcgtcggtcgagcgggccggcagcggcagccggctcgtcgagacggccggcgagcgcatgacggagatcgtccggtcgatcgaccgggtggccgacatcatgggcgagatttcggcggcgtcggccgagcaaagcaccggcatcgaacagatcgggctggcggtcgcgcaaatggacgaagtcacccagcagaacgccgcgctcgtcgagcaggcggcggcggccgcttcgtcgctggacgagcaggcggcgcgcctgcgggccgccgtatcggtattccggctcgctgcctgacgactgcacgactgcacggccgcacggccgcacgggtccggtttcccggcggtcccgtcatgctcccgtcttcccgccaagccgttccgatcgagcggcattcttctgaactttcctgcgcgacgtcccgtcgcgatccccgccgtcgacgcccgtgcatgcggcgatctgccgcaatacaccatgcgtttcagccgtcatcggcatgcggacacgcattcgacacaaacgtgcggtttgcgtgtgccaaacgcgcgccggatgccgaacggacaattttgtcggcgcaatctgcggcggctgcggccttacgatttcctgcatcgacacgggttgggcagccgccgcgacacgccgccgggtacacggcgacacgtgggcgcacgcagcaattcatgctgcgcgggcggctcaaaacggtcgattcgtatcgtgcgggcggcccgaatcgcgacaaaccgcattttggcgatgcttaaatgaattgcatgtgtacgacgttgcgcccgccaccagcaagcgggcactgcgggattcgagaaccacgctggaccccagaccccactttcaacagtcaggagcagttcggatgagcgacgatatcgacaacggcggcggcaacggtggtttcactcgccgcgacatgatgaaggtcatggcggcgagcggcatgatggccgccggcgccggcggactcctgatgaaccccgcgaccgcattcgcggcgcccgcggcgaaacgcggcggcaagatccgggtcgcgaacgaatcgggttcgacggccgatacgctcgacccggccaagggctcgaccggcgccgactacattcgcttcttcatgttctacagcggcctcacgcagctcgatgcgagcctgacgccgcagatgaacctcgccgagtcgctgcagaccaccgatgcgaagacgtgggtcatcaagctgcgcaagggcgtcacgttccacgacggcaagtcggtcggcccggccgacgtggtgtattcgctgatgcgccacaagaacgccgccaccgcatcgaaggtcaagccgctcgccgaccagttcgccgacgcgaaggcgagcggcccggacgaagtcacgctcacgctggtcagcgcgaatgccgatctgccggtgattctcgcgacgccgcagctcgtgatcgtcaaggacggcacgaccgacttcagcaccggcatcggttgcggcccttacaagctcaagtcgttcaagccgggcgtgtcgaccatcggcgtgcgcaacgacagctacttcaagccgggccggccgtatctcgacgagatcgagctgatcggcatcggcgacagcgccgcgcgcctgaacgcgctgctgtcgggcgacgtgcacctgatcaacgcgatcgatccgcgctcgacgcagcgggtctcgtcgacgccgggctacgcgctgaaggaaaccaagtcgggcctctacaccgacctgatcatgcgcagcgacaacccgatcgtctcgaatcccgatttcgtcgaagggatgaagtacctgttcgatcgcgagcagatccgctcggcggtgttccgcggctactcggtgatcggcaacgaccagccgattccgccggggcatcgttacttcaacgcgtcgctgccgcagcgcgcgcacgatccggacaaggcgaaattcctgctccagaaggcgggcgcgctgggtgtcacgctgccgccgatgtatgcgacgtccgacgcgaacgggtcggtcgagatggccgtgctgctgcagcaggccggccagaagatcgggctgaacctgcaggtcaaccgcgcgtcgcccgacggctactggtcgaaccactggatgaagcacccgctcaccttcggcaacatcaacccgcgctcgagcgccgacgtgctgttcacgcagttcttcaagtcggatgcgccgtggaacgagtcgggctggaagaacgcgaagttcgaccagctgctgctcgccgcgcgctcggaaaccgacgacgcgaagcgcaagcagatgtacggcgacatgcaggtgatcgtgtcgcagcaggggcgggtcggcattccggccttcatcagcttcctcgacggctacgacaagcgcctcgccggtctcggttcgatcccgaccggcgggatgatgggcttcatgttcgccgagcacgtgtggtggaacgcgtgacgtcgttgctggcggccgccgtgcggccggtgcgggcgaccgcgccggccacgcgcggccttttcgggagtgtcgcttcatgaaccgaattctcatcggcctgatcgtccgacgcatcgcggtcaccgcgctgacgttgctgatcgtgtccgcgatcatcttcacgatcacgaacctgctgcccggcgacgccgcgcaggccgcgctcggccagtcggcgacaccggagacgattgccgcgctgcgccagcagttcggcctcgacatgcccgcgcacgtgcgttacgcgcactggctcgccggcctgatgcacggcgatttcggccgttcgctgtccggcgacatgccggtgtcggagatgatcggcggacgcctgccgaagtcgctcacgcttgcggcgatcacgaccgccgtgtcggtgccgatcgcgctgctgctcggcatcctcgcggcggtcaagcgcgagtcgctggtcgaccgcgtgatcagtctcggcacgctgtcgctcgtcgcgacgccggaattcctgatcgcgaccgtcgccgtgctcgtgttcgccgttaagctgcgctggctgtccgcgttgtcgtacagcggcgagatcgaaagcctgcacgatttcctgcgtgcgtatgcgatgccggtgctgacgctgtgcgcggtcgtgatcgcgcagatggcacgcatgacgcgcgccgccgtgatcgagcagttgagcgcgtcgtatgtcgagatggccgtgctcaagggcgcgagccccgcacgcgtcgtgctgcgccatgcgttgccgaacgcgatcggcccgatcgccaatgcgatcgcgttgagcctgtcgtatctgctcggcggcgtgatcgtcgtcgagacgatcttcaactatccgggcctcgcgagcctgatggtcgacgccgtcagcaaccgcgatttcccgctggtccaggcgtgcacgatgatcttctgcgtcgcctacctgacgctcgtgctgttcgccgacctgtgctcgatcgtgtcgaacccgcgactgcggacctgaccgtcccgtccttcttccgagatgccgcccatgcacccgaccgaccccgttcaacgcagcaacacgctgccgccgtccggcgaaccgcgcccgccgtggggcggcgcgacgccgcccgccgccccggcccccgaccagccgcgcaagcgccgtgccgcacgcatcgaattgacggccggcggccgtgtcggcctgtcgatggtcgggctgatgctgttcatcgcggtgttcgcccgctgctcgcgccgcacgacgtgggcgcgatcgtcacgccggacgtgttcgcgcggttcagcgcgaagctgccgttcggctccgacttcctcggccgcgacatgctgagccggatcctgtacggcacgcggctcaccgtgctgctcgcgctcgccgcggtgctgctcgccgcgctgaccggcacgacgctcgggctgctcgcgaccgtgtcgggccgcgcggtcgacgagacgatgagccggctgctcgacgcgctcacgtcgattccgtcgaagatgttcgcgctgatgttcgtcgccgcgttcggctcgtcgctgccgctgctggtcctgaccgccgcggtcagctacatgccgggctcgtaccggatcgcgcgcgcgctggcggtcaacatcagcacgctcgaattcgtgcaggtcgcgaaggcgcgcggcgaaagcgcgctgtacatcgcgtgcgtcgagatgctgccgaacatgattcatccgatgctcgccgataccggcctgcgcttcacgttcgtcgtgctgctgctgagcggcctgagctttctcgggctcggcgtgcagccgccgtatgcggacctcggctcgctcgtgcgcgagaacatcgcgagcctcggcgacggttcggctgtcgcgatcatgcccgcggtcgcgatcgcgatcctgacggtgggcgtcaacctgttgatcgacggtctgccgcatcgcggccgccgcagggcgcggccgcggccgccggagaacactgatgcgagatcaatcgactccgctcgtcgaggtgcgcgggctgcgcgttgtcggcggtcgcccgggcgccgcggaaacgacgatcgtccacgacgtcgacttcgagatcgggcgcggcgaggtgctcgcgctgatcggcgaatccggctcgggcaagacgacgatcgcgctgtcgctgatgggccacgcgcgcaccggctgccggattgccggcggctcggtgaagatcggcggcacggacgtctgcaggctgtcggcgtcgggcctggccgcgctgcgcggccgcaaggtcgcgtatatcgcgcagagcgcggctgcctcgttcaacccgtcacgcacgatcctcgaccaggtgatcgagagcgcgctgattcaccggacgatgtcgaagcgcgatgcgcaggcaaaggcggtcgagctgttccgcgcgctcgcgctgccggagccggagacgatcggcaagcgctatccgcaccaggtgtcgggcgggcagttgcagcggctgatggccgcgatggcgctgatcaccgatccggagctcgtgattctcgacgaaccgaccacggcgctcgacgtcaccacgcagatcgacgtgctgcaggcgttcaagagcgtgatccggcgctacgggatgagcgcggtctacgtgtcgcacgacctggccgtggtcgcgcagatggccgaccggatcgtcgtgctgagcgacggcgtgatccgcgagacgggcgataccgaacagatcctgcatgcgccggcgcacccgtacacgcagagcctgatcgcggcggtcacgccgaacgatgcgcaacgcgacggaaaccggcgccggccgacccggcgccgttgctcgaggtgcgcggcgcggtcgccggttacggcggccgcaacgcgaagggctggcccgcgaagctgatcctgaacgaagtcgacctgcgcatcgggcgcggacagacggtcggcgtgatcggcgaatcgggctccggcaagacgacgctcgccaaggtgatcgcgggcctggtgccggcggcggccgggaagatcctgctcgacggcgagccgctcgcgcgcgatatcggcaagcgcaccaaggagcagcaccgccgggtgcagatcgtgttccagaacgccgacaccgcgctcaatccggtgcataccgtcgagcgcacgctcgcgcggccgctcgcgttctaccacgggatcaagggcgtgcgtgcgcggcagcgcgtcgcggagctgctcgaactcgtgcggttgccgccggcggtggccgcgcggcgcaccggcgagttgtcgggcggtcagaagcagcgcgtgaacctcgcgcgcgcgctcgcggccgaacccgacctgatcctgtgcgacgaagtcacgtcggcgctcgacaccgtggtcggcgccgcgatcatggacctgctgcgcgacctgcaggcgaagctcggcgtgtcctacgtgttcatcacgcacgacatcgcgaaggtgcgcgcgatcagcgacgacatcgtcgtgctgtatgcgggccgccgcgtggagacgggcagccgcgacgcattgtgcgcgccgccttatcacccgtattcgcacctgctcgtgtcgtccgcgccggagctgcgcgcgggctggctcgacgatgcggccgagcgctgccatcggccgctggtgccgatcggcgagcgcgcggacgacggtgagctgtgtccgttcctgtcgcgctgcgcgatgcgggtggacggcgtctgcaaccggacgccccggtgctgcgcaagctcgacaacggcgcgcaggtgctgtgccatcgcaacgaggaagacctggcgcgcttccaggccgagccgacgcaggcgggtgccgcgcccgggcagcccgtgcagctgtaatgcgtgacacgccgccgttcggcgcgcgcgacgtggcggccggtgcaccgcatagtctgctgcggcggttgcgcaaaacggcgatttgcgcgcgtgccgcgtgcgaatacgcggcaactgcggtttttgatggtgattaaatgatttcccgtgaacggcagccgatcgtcgtcgccaacaagctcgagaaggacccgatgaaattcgaatcgtactggctggatacccgccccgcatttcgcgcgggctgcgagggccccgtcgaagggcgcgccgacgtggtcgtgatcggcggcggctttaccggcttgtcggcggcgctcgcgctggcgcagcgcggcgtatcggtggtcgtgctcgaagccgcgcaggtcgcgggcgaagcgtcgggccgcaacggcggccagtgcaatacgggcgtcgcgcaggattacgcgtcattggccgcgcgcatgggcgcggagccggcgaagcagttctatcgcgcatacgaaagcgcggtgaagagcgtcgagacgatcgtcgccgaacacgcgatcgactgcgatttccggcgcgcgggcaagctgaagctcgccgcgaagccgcagcatttcgcggggctggcgaagacgttcgacgcgttgcggcgcgacgtcgatccggacatcgaactgatcgaacccgagcggattcgcgatgaagtcgcgtccgacggcttctacggcggactcctgcagcgcaacggtgcgcagatgcacatgggcaagttcggtgtcgggcttgcgcacgcggcggtgcgcgcgggtgcacgcgtctacgagcatgcggccgtcacgcagctggaccggctcgacggcgagcggcacgcgattacctgcacgcgcggcaggatcgtcgccgatcgcgtgctcgtcgcgaccggcgcatcgcagcacggcccgttcggatggttccggcggcgcatcgcaccggtcggcagcttcatcgtcgtgaccgagccgctcgccgacgcgcagttgaaccggctgttcccgcatcgccgtgcgtacgtgacgtcgcgccagatcggcaactacttccgcgtgacgcccgacaaccggctgctgttcggcggccgcgcccgcttcgcgatgtcgagcccgcgctccgacgcgaaaagcggcgacatcctgcgcgccggcatggccggttatttcccggaactggccgacgtccggctcgactactgctggggcgggctggtggacatcaccgccgaccggctgccgcgcgcgggccagcacgacgggctctattactcgatgggctacagcggccacggcgtgcagatgtcggtgcacatgggccgcgtcatggccgacgtgctgtatggcgcgacggcctcgaatccgtggcgcgagctcgactggccggcgatgcccgggcatttcgggcacgcgtggttcctgccgttcgtcggcgcgtattaccgggtgcaggatttcctgcactgaagcgggcgccggggagaattcaacatgaaagcgcgtttcgtttgcccgtcagcgggcgtcgccttgccggccgtgacacagcaggcggcgacatgaggactgccagcatgctcgacctgattcacgattcggtcgaagacacgacgccatgcacgccgcgcgtcgcgcggcccgtctcgccggcgatcggcgatgtgctgcgcacgatcgacgcgtcgttcgcgcaaccgctgaatctcgacacgctcgcggcggtggccgggttgagcgtatcgcgtttcaccgcgcgctttcgcagcgaaaccgggttgtccccgcaccggtatctgtgcctcgtccgggtgcggcgcgcgcaggacctgttgcgcgccggtgtggcgccgtcggtcgtcgcgaccgacgtcgggttcttcgaccagagccatctgtgccggcattttcggcgggtgctcgggatcacgccgcgcgattgcgtgatcgcgcgaccgggcggcgcatcggcgcgcacgacgtcggcgcgcgcgcacaccgaacgccgcgcgggcgcaagtgcgggcggcgtgcacacctgacgggattccggcgggttcgccggcgaacggagatttccaatattgcgcgacggttttcgattcggccgccgcgcactgcagaggagcagaaatgaccgcagctttcgtgttgcatcgtgccgacggcgcgccttgttccacctcgttccgcaagcaggcgttcggcgagggcgatcctttgcgcgacatcgggaaatcgcctgggaagggcccgactcgatggccgcggggcgtatcgccttcgtcggcgaactcgacgtgacgcactttccgcacatcgaaacgatcgcggttatcgaaggcgagctgacgctcgaagcggccggggccgcgccgttggtactcgggccggggaaggggcagtcatcggcgccggcacggcgcttcgcatcgccgcggaatcgcgcgtgttgctgatgttctgcgcagccgcgtgcacgacgccgacgaaacacggcctgtttccgctgcgggccgacgccgacttcaagccttccgcatcgctgccgcccgaggtgctgctcggccccgcaccgcaatgccgcagcgacaacgtgttcctcgacgacggcgccgggtattgcgccggtacgtgggattcgacgccctatcaccggatcgttcgcccgcatcgcgtcaacgagttcatgctcctgctggccggcagcgtgcggtttgccgaccccgacggcagcgtgctgtcgctcggcaccggcgatgcgctgttcgtgccgcgcggtgcatcgatcgggtgggaaagcagcgaacgcgtcgcgaagttttacgtcgtgcagaacgtacgtgcctcaaccgaacgagactgaccatgtccccaccgctgcgccttatagaaacctcgcccacgccgccggcatcggccgacgtcgtcgtgatcggcggcggcatcatcggcgtctttaccgcctattacctggcccggcgcggggtatcggtcgcgctcgtcgagaaggggcgaatcggtgccgagcagtcgagccgcaactggggctggtgccggcagcagaaccgcgacgaacgcgaattgccgatggcgagcaagagcatcgatctgtgggaacgattcgccgccgaatccggcgaagacaccggctttcatcgctgcgggctgttgtatctgagtaacgacgaggccgagctgtcgcgctgggccaactggggcgagttcgcgaagaccgcgggcgtgacgacgtacatgctcgaccgcaagcaggccaccgagcgcgggcacgcgaccgggcggacgtggaaaggcggcgtcttttcgccgaccgacggcacggccgacccggagaaggccgcaccggccgtcgccgccgcactgatgaagctcggcggcagtgtccaccagcactgcgcggcgcgcggcatcgaactcgagggcgggcgtgtcggcggcgtcgtcacggaggccggcgtcatcaagaccaggacggtcgtgcttgccggcggcgcatgggcgtcgtcgttctgccgccagctcggcatccgctttccgcaggcgtcgatccgtcagtcgatcctgagcgtgtcgcctgtcgagcatccgctgccgggtgcgatgtatacgtccggtgtgtccgtgacgcgccgcagcgacggacgctacgcgctggcgatcagcggtcgcgcgcgcgtggacgtgacgccgcagttcctgcgattcgcgccgcagttcttgccgatgttcgcgaagcgctggcgcaatcttctgccgggctggctcgaaggcgtgcgcggcgggcatgaaacgctgaagcgctggcggctcgatgaaccgacgccgatggaggcggtacgcattctggatccgaaaccggacatgccgacggtcaacgagacccaccgccgcgccgccgaactgtttcccgaacttcgcgacgcgaagatcacgcacgcttgggccggattcgtcgacagcacgccggacggcgtgccgggcatcggcgaagtgccgggtgtgccggggctgatccttgccgcgggcttttccggtcacggcttcggcatcgggccgggcgccgggcatctgatcgcggatctcgcaaccggtgcgcaaccgctggtcgacccggtgccgtatcggccggaacggttcagcgattccgcgtggggcaaggtcgcggatttctagtacgcggggcgacggcggccatggcgcggaccgtggtcatgccgatggcgcgaatcgtcgacggacggtcgacggacgcgccgctctcaacccgtcgacaagcttcgatcggcccgttatatccgaccgcttcggcagaccgtcgttcgtgccgttcgcgggcgtgcagcaccgcctcaaggacatcctgcaatgaattcatccgtcatttccccgttcgtcacctgatgcaagccggcaggctggatcgtttcttcatcgacggcgactgggtcctgcccgacggcggcgaccggttcgcggtcgtgtgcccgtccaccgaggacacggtgtgcgacatcccgctcggcagcgcacgtgacgccgaccgggccgtcaccgccgcgcgccgtgcgttcgaacggtggtcggccacttcgccgcaggcgcgcgccgcgctgctcgatcgcatccacacgttgatgctggagcgggcggaactgttcgccacggcgctggccaccgagatgggtgcgccgatcgcctatgcgcgcgccgcgcacgtgccgctcgcggccgagcatatccgggtcgcgcgcgacaatctcgcgcgctatccgttcgtttcccgacgcgggacgaccgcgatcgtacgcgagccgatcggcgtgtgcgcgctgatcacgccgtggaactggccgatctaccagatcaccgcgaaggtcggcccggcgctcgcggccggttgtacagtcgtcctgaaacccagcgagctgtcgccgctcagcgcattgctgtttgcggaagtgatcgccgatgcggggtgccggcaggcgtattcaacctggtgagcggcaatggtgcggaggtcggctccgcgctttcgtcgcatccggaggtcgacatggtgtcgatcaccggatcgacccgcgcgggcgtgctggtcgcgcaggcagccgcgccgaccgtcaagcgcgtcgcgcaggaactcggcggcaaatcgccgaacatcgtgttgccggatgcggacttgcagcaggcgatcgcacccggcgtggccgccgcattcaggaacatgggccagtcgtgcagcgcgccgacccgcatgatcgtgccgcgcgccgcgctcggcgcggtcgaggcgctggccgtcgcagcagtggagcggctggtggtcggcgatccgttcgccgaggcgacgacgcatgggccgcttgccaatcgcgcgcagttcgggcgggtcgcgcagatgatcgacgcgggcatcgacgagcgggcgaagctcgtcgccggcggcccggggcggccggcgggattcgatcggggcttctacgcgcggccgaccatttttccgacgtgcgcaccgacatgacgatcgcgcaacaggagattttggtccggtcctcgcgatccttccctacgacacggtggaagaagcgatcgccattgcgaacgacacggtgtacgggctcggcgcgcatgtgcagggcagcgaccacgaaagcgtacgcgcggtggccgcccgcatccgggcagggcaggtacatcttaactatccggcatgggatccgcaggcgccgttcggcggctacaagcagtcgggcaatggccgcgagtacgggatcgaagggatggaggactacatggaaatcaagtcgatcatcggcttttacgactgacgcagccgctgcgtgcgaacgcggcggcagcacggactggaagccgcttactttcggaaggtgccgaaattggaaaaacctgtcattcccgatacgtcgctgcaagcgcatcacgcgcattgggcaaggctgcggcgcgatctgcatgcgcatcccgagctgcgattcgaagaacaccggacggccgacgtcgttgcccgcgagcttgacgcgctcggttatgcggtatcgcgtgggctgggcggcacgggcgtcgtcgcgagcctgcccggtgcggacccggcgcgcggcatcgtgctgcgtgcggatctggatgcactgccgatccaggaagccaacgacttcgcgcacgcatcgtgcacgcacgggatcatgcatgcatgcgggcatgacggccataccgtcatgttgctcggcgccgcgcgcatcctgaaggagttgccgccattgccgggtgccgttcatttcgtgtttcagccgggcgaagagggcggcgcgggcgcgcgcaagatgatcgacgacgggctgttcgagcaatacccgaccgaagcggtgttcggcatgcacaactggcctggcttgcccgccgggcatttcggattgcgtaccggcccgatcatggccgcgggctcgcgcttcaggatcaaggtgaccggcaagggcgcgcacgcggcgcagccgcacctgggcatcgatcccgttccgctcgcgtgttcgatggtgctgcagtgtcagaccatcgccgcgcggcacaaggatcccgtggaccctgcggtcatttccgtctgcatgatccatgcgggcacgacggacaacgtcattccggatagcgtcgagctgcgcgggacgatccgcacgctgtcgtccgcgttgcagcagaaactgcagacagacgtgcagctcacgtgcgagggctggcgcgcgcgtatggcgcgcaggtcgacgtcgagtttttccagtattacccggcgacggtcaacacgccggccgagacggcgctgtgcgaagcggtgatcggcgacacgttcggtggcgaacgcctgtaccgcgacgtgccgccgaacatgacgtcggaggatttcggcttcatgctcgaggagcggcccggcgcttacgtgctgatcggcaatgcgccggagggcgcggcggcaccgtcgctgcatcacccgaagtacgatttcaacgacgaaatcatcccggccggtgtccggtattgggtcgcgctggcgcagcattactacaggcgatcgtcgtgaacctgtgcctgatatcggggcgcggcatcgtgctgcgctagatatgggacgtgcgcacgctgctcgacagcgtgcgcacccgtgcaggtgctgcccggcgtcgcgcagcccgcgaacgtgcgggcggtgtatccggcacggctggctgcgtcggcgaaggtgcgtgtgtcgactgtccggcggacgtattcggccgcatggcctggccggccgtgttcggtgtcaacctccgccgtgtcacggccgtcgtatcgtcaggccacgctgccgaggcgcgtcgccaaatgaccgcatgcgatgaaagccatcctcgtagctgattgacgattgcaggaagatcgtcttttgtcatacgacaaaggtttcacgctcccgaacaagttcgcctgtccacgggcgaattgcgccaggcaggaccgtcttcacggaacagcgcaaattctcaggatcgaaacgttccgacatgcaggccgtcgagcccacacgattcgtgatccatagcatttttcaccccaccggctcggccgcaaaccaggcgcagagtcgaaatgcatttcctcttcccctgccggcatcgatgatccctgaagccggtaccaccgtgcatcgccgccgcgcgtttctttggcgttacgttttttgcgttgcgatgtcgttctccttcgtctgttgccggcccgcttcggtggaacggtgcctggcatcgttaatgcatgtgtggtcggtgtgatgagcaaacgagggccgcaactgcacgctcgacacacgcatcgggtgtctgccgtttgcgggtgcagtcgcggtcatcacagggcgacgtgaccgacgccggtggcggttccgtcgtcacgcgagtgacgatgcgtggcgcaattcgtatgaggttgtttcaggcatcgacgtccccagggttcgcgatcgccagacactcaatgctcaggccaggcgttgttccgatgacatacctccggttttagcgcagagaccagtgaaaggagttctccaatgaaatccccactcaagcttgccgtggcatgtgcagcgatcttgtccgcgacggcattgatgagccccgtttgcaacgcgggagcgtccggtgcttccgcctcacacaaacgcgtcgagccgccaccgcgcgcggctgtcgcgacggagatcgtgccaggcgtggcggaagacgagaaacggaatgccgagcgcgagcatggcaggggaccgaccttcaacgaaggcaaacatcgtcgggccaacggcgacattcagcgcgactaagcacgaaggagatcacaatgaagaagctcatcctcgcatgggtgctggtgctcggattcgcattcggccagatgccgtccaccgtgctcgcccagaccaccacggcgaacgtcctcgtgctctatgacgccccaccgaacgacccgtacacgaaactcggcatggcttacgcgatcatgctgcgcaatctgcttggccatttcaacaccaatgtcacgcttgcgcccgtcgacagctatacggccggaaccgtcgaaaagtaccaggcgactttctacctggggaactattacaacaacacccttcctgccgcatttctgtcggacgtcgtcaagacgtcgaagacagtggtctggttcaaggacaacctgtgggaagtcgcgtgggatccgtcgtacaacttcacggcccgctacggattcacctttagcgggataagcgggctggcctacgcgccgaccagcagcaacccgaacccggacttctttgacacggtgctctacaagaacatgagcatggtcaaatactatgcgttcaacgcgagcaccggcgtcatcagcgcggacccggacatcggcatcaccgcggtgtccgacgcgacgaaggccagtgtactcgtcaccatcaaggacagtcagaccggtgcgcaggcgccttatgtcatgcgcgcgggcaatttctggtacttcgccgacatgccgttctcgtacatcgggccgcgcgaccggtacctggtgatctgcgatctgctgcatgacattctcggaaccaaccagccggtgctgcatcgcgcgatggtgcgtctggaagacgtcaacgcgttcacgacctcgtcgtcgatgaagacgctgaccgactacatgtattccaagaaaattccgttttcgattgcgaccatcccgctgtaccaggatccgctcggtgcttataacggcggtgtgccgctgaccgtacacctcgcgcaggcgagcagcctgaagcaggcgctcaattacgcgctgatccggggcggcagtatcgtgatgcacgggtacacgcatcaatacaattcgacgccgaatatcgacaacgcggtcagcggcaatgactacgagttctggctggcgacgcagaaccgtccggtggacgaagattcgacacagtgggcatcgaaccgtctgaaagcgggcctgctggaactgtcgacgaacggctatgttccctttgcgtgggaagcgccgcactaccagtcgtcgcccctttcgatcaaggccgttccgccgctgttcaagacgacgtaccagcgggtcgtctactacacgtcggatcagccgaacctgaattcgaccgcgccgaatcacgatttttcggtcgggcagttcttcccgtacatcatcaataccgactattacgggcaacgggtgctgcccgagaacctcgggaacatcgaatacaacatctgcggtatcgatccgttctcgtgtctgtcctatacgtggcaggatctctacacgaatgcacagtacgcgctgacggttcgggatggtttcgcgtcattcttcttccatccgttctggctcgagcccgatctcggcacgcccgggttccaggatttccagagcctcgtgaacgggatcacaggtctcggctttcagtgggtcgccgggaatggcgtcaagtagatgattccggaatcgggagggagccggggagccgggctcgactccctcaccgggttcgatggcgccacgtttcgcttcgcctgatggcgagtgagataaatccaaggggatcgggccggaaaatctgctcgcgaccgcacacgtttttctattgcgccccgccgtactggcagaccgagggctacggcgttgcatttccgttcgaggagtacgagcagatggcggccaccatgcggacccgcgccggcaagatcatggtcagcatcaacgaccatccggatatccggcgggtgttcgaggggttcgagatggagaaggccagcctcaactacacggtaggcaagagcggccgcgatgccgcgcgcggcgagctgatcgtgtacagcggggatcgggcggccgcgccggccgggctgttccagaggcaatgcggtaaagtatcgccttcgcagggggccacgctgagagagcagcgcccttgctggaccaggagaaaaattgaatagccgaaaaccgctacaccttcggcacctggcacaatctgcggcccgtcgacgcctttgccctggtggcgctcgacgagatacgcaagcaactcggcctggacgatctggccgccgcgtcggcaatgctgctcggtcagggcgacgttcctgttccgggcaagttcgctggtgctacgccggggacttccgtcgcctcgcttgccgcccggaaactgtttcccaaatactgccgtttcgcctgccgatgatcacgggcgtcgggttgtccggtattcgaatctccttcacccgccgcctcggcgcatgggtcggccggacgattccggtcgtaggcgaggtgttcctggctcgcgatgcgttcctgatcatgcgcaataccgtgacgacctacaaccgactcgtgaagcccgaggatcgggtgctctgagccatgaaagacgatacctgggaacgttttgaagccttcacccggaaggaactcggccggccattgttcggtggccagttgaaccttcagccggaatcgcggcttgaggaggatctcggcgtgactggcctggatggggttgagttcatcgacaagtgggccgagacgttcggcgtcgacgcccaagggttcccgtaccggcgctatttcggcccggaaggccaggaactgctgtcgtcgctcattgggttgttcgtgaagcggctgcggccgccgaagcgccacccgctgacgctcggcatgctggcggaggcaacgcgacgtgggaagtgggatacggacgcgatcgaggctgctgcagggagtgatcgtatttgataggaccggtcggcgtagccgaccggtctttcattggcggaaatatagttgagccacgtgaaatttttccatccacccatttatcgcgcgtcagccggtgcatttatcgcgcgcggcttcattcgccggaacgacccgggcgcggcgcacggacgtttcgcatggacgtcgccgccggtcggaggcgacgtcgcacggatcgatcgctgtgccggttacgccgccgacagcacgatcgacaccccgtcgccgtatagaccggcgtcgccttgaagccgtcgacggtcaccgtcgagaatttcgccgcgcccgctgccgcgtcgatcagcgcgatggtgtcgccggccttcggcgcataaccgttcacgaatttcacgtgcagcgtgccgcccgcgacgatgaacgcgccgcccacgcgcaggcggccgccgccgttgccgtcgatgtcgagttcgagcgtcgtgttgtcgagctgcgtatagcgcgtcgcgatcgtgacgggcgcacccgccgcgatccggatgccgccgccggcgccgacatacacgtcgccgttgccgaacgccgtcgcggacgccgcggcgagcgtgccgccgctgacctgcgtgccgcccgtatagctgttgttgcccgcgagcgtcagcgcgccgctgccttgcagcgtcagcttgccggtgcccgtgatgtcgttgcgccacaggtcggcggcgttgaggccgcccttcgacgcatccatcgcgacgatcacgttgccgttgaatgcgccgtaaccgtcggcggccgcgaacaggttcagccggccccagccttccgcatcgtccatcaccgggtagccggacggcagttcggtggtcttcagcacgacgcgccgctgatccgcgcccaggtacggaaaacgcgtctgcagcaggatctccgccccttcggcacgaccggcggcgcgccggtcgcgtcgagcgcgccgaagccgtaggtcatgcggcgcgcgaaggccgccttgttcgtcgcgtagtcggcgaagcggtcggtcgccgtcgtgcccgagtgcgcgaatgccgggaacgtcgaaccggtcgtgccggtgagctgctgcagcgtctggtgcgcctgcccgtaggcggcctgcgcgtcgttcgcgtacgccgcgagattggccgcgctgatcgccagcgcgagcatgcgcccgccgatcacgtcgagcggcgagtgcatgccggcgaggatgcggttctcgccgagttcgaggccgcggctgaccatttcctggtagcgctcaggcacgagccacgccatcgtcacggcgtcgcgcatcgcttccgcctggtggccgctgatgaacccgccgtcggtcgcgggcgtcgtgctttccgcgggcacgagcgtgggggcgacgacgacgcccgtgctccagcggtacggccgcgcatacttgtagaagcgtttcgcgggttcggtcgacgcgttgttgcccatctcgttgagcaggtcgacgactttcccgaagctcgcgttcgcgctgccgcccacgcccacgttgttgcccgtgtcgttgtacaggacggtcgtcgcgtcggccggcacgctggtgatgctggtcgtctgctgcgcggcggtgcgccatgcggaagtgagcggccccatgccgtcggtcacgctgtagcccttgccgcgccggtcgtcgtagtacgcggcgtcggcttgctgcggcgtgcgtgcggtcgtcgcgttgaccacgtattgcacgttcgcccgcagcaccgcgtcgttcaggatcgtgccgcacggcgtgccgttgccgggcagccccgtgcaggtcgacggcgaaatggccggaaacgcgccgttggccggcgcgctcacgcccgcatcgacgagcatcgtcgacggctgccacaggtcgaggaagcggctgactacgcgcaccgcggcgttcgtcgacagcgtcgcgtagcgcgcatcgccgcgctggttggtcgcgacgttgtcgacgaaggcgggcacgctcggaaccggcgcgctgtcgacgaaaccgggatcggccggcggcgccggcatggccgcgctggtcggggtggtcgaggcgacatcgtcgccgccgccgcacgcggcgagaacgatcgcgctcgacagcgcggcgacatgcagcgggaaacggcttcgtgacgcaaacatgcaagactccatcctgatggtcaaagatggcgaattgtggtgacgattcgttacgcggccgttaaggatttgttgcgtgtcgtgctctgtgcgcgaaaattcccactatctggttaattccagatactgaacatctcggatgccatttttacgcacccgagacggatatgtagcggcgtgccgctacgcgccggccatacgcgtggatggaaagtccggcggcctcgatatcgaacaacgatccctgttgccgcaacgacccatgacggaacagtggcccggggcaatcgttggtgtgcaacccgcggcccggagccgcgactcgacccgtggccgtcatgccgagcgcgcggacggctccgtttccgcgcaacacacccggtttcggccttcgcgcttcgcgcggtaaagcgccatgtccgcctgatgcgacagcgcgtgcacggaggcggggcgtgcgcgatggccggtcgcgcagccgatgctgacggtgaacggcggaacgggttccgcgaacccgtcgagccggttgtgttcgacctcgcggcgaatcgcctccgcgaccttcgcggcgccgcgttcgtcggtgtcgggcagcaccgcgacgaactcttcgccgccgtaacgcgcggcgaggtcgccgcgccgctgcgtatgggcacggatgcatgcggcgaggaaccggagcgccgtgtcgccgcgtgcgtgcccgtatcggtcgttgtactgcttgaagtggtcggcatcgatgaacagcaccgacaggctgccgtcgtggccgcgctggagccgttcccattcgtcggccagcgcgacgtcgagcgcgcggcggttgtgcaggccggtcagcggatcggtgcgcgtgaggtcggtcagcagcgtctgcttgcgaaggttgtcccgcaacgcgaacgcgagcagccagacgaccgcgcagaaaagcgcgcagaggagcgacgccgacacgccgaccgaccacgacatccggatgaaaccggccagcacgtcggcttcggccggcgcgacgacggcgatcagcggtgtgccgggcacccgctggaacgtatagagccgcagcgttccgtcgatgcgcgaatgcgccgcgtagaagcccgaatcctggttcagcatgcgatcgaaggctttcgagcggcgcaggcgaaccatctggtgatcgttcagcgacgggttgcgggcgaggatggtgccgtccgcgcgcacgatcgcgctgatgccgtgcggcccgacgtccagccgcgacagcagctgatcgaaataggcgaggtcgatcgcgaccaccgcgatgccgttgaacgtgtggtccggtcgttcgatgcgccgggaaagcgcgatcgactccgtgccgccgcgcgagcgcgcgcgataggcctccgacacgtaaaggccgacgttcggcgagtcgcgatggaccttgaaatagtcgcgatcgccgaagttccagtggtgggacgggccgcagcacgcgtcgatcagccggccgtcgcggtccgtcacgcccattcccgtcacgtattgcgcggccgcgcgctggaacagcaggtcgtgccgcagcccggcgtccatgcgtcgcacctccggcttgccgagatcggcggagagcgcgatcagcgcgttgttggacgtttcgacggtccgcgcgatctcgctgaccagcacggcggcgacgttgcgcgaggtttcgtgcgcgtgctcgacgacttcgcttctcgtggcccagagcgtggccgcgctgatgccgatcgccgcgagcgacatcagggtgcccagcgcaccgacgacaagatggtttcgtcccgcccagtcggcgattttctcgatggaggtggatgcggacatgctggcgctcgcaggggaggcccggcgcgatgaaccgggctgcgctgaaacccggttaacggcaggtcgtcgaagaaatcgaggcccggctgcaatccaagtgggcgcggtgcggcccgcaaacgtgtgcgggccgggtgctcgacggggcgcgtaccggaaagcgcgagcggggcgcggctggcgaagcgatcgcgtcgcgggctggacgatcggcgcggcggaatccggaacgcgggcctgacgcggtgccggcgacgtcccgtccgcgcgatcaagccggcccggccgcgtccgtctccgcgtcatccgtcgccgccgcgtggcgcacgcgtttcagcgtaccggccagcttctcgatcgcatgcaggtccagcgtatcgagatgctcgcgcacctcctgcacgaaggccgcgtaatcctgttcgttcgcgtactggccgagccattcctcgatatcggtgagctgcccgttgccggcgagccggatcagcgcatcgagtgcatcgtcgggcgggcagcccatcgcgggcgcggtgccgcccggcacgacctcgtccaccgcatgaaaccgccgcacgagctccgatgctggcacgagcacgtgcccgacggccggcgcgacgatcgcgaacgagaacgacgtgccgacgccgggctggctcgcgacggccagctcgccgcccatcgcgccgacgatgcgctgcgcgatgaacaggccgagcccggtgccgccgttgacggcctgcacctgctggtacgcgcgaaagatgtcgcgggtgccgctgatgtcgatgccgatgcccgtatcggcaacctcgaacagcaggcgccatgcgtcgccttcgcgcgacgcatgcaccgacaacgtgaccgtgccgtcgcgcgtgaacttcgatgcgttggacagcaggttcagcagcacctgctgcagccgcatcccgtcgatcgacatcgtgcgcggcagcgggctggccggccggtacacgaaccggttgtcctgctgcgcgcacagcgcgagagcatagtggccgatgtcgtcgagcaggccgggcaggtcggtcgcgtccggcgacacgccgagcggctgcagctcggccttcgtgaacgcgagcagttcgtcgatcagcgtgagctggtagcggatgctgcggtcgatcgagcggatcagccgcgcctggccgcgcgtcgcgccttgcagcagcagcttcgcgtagccgttgatcgtcgacagcggcgcgcgcaggtcgtggctgacgtagccgagcgtctcgatcttctgctgcatgtgcgtcgtgacctgctggagcgcgtcgttgagcgcgagcgtgcgccgtgcgacttcgtcgcgcaggcgatcctgttcggtgagctgccagtgttcgagccgcttgcgcgcctcggtgcgctgacggcccacgtggtggatccacgcggccagcaccagcaggtgcgtggcaagcccgacgatcgcgatgacggggttcggatagatgtcggacttgagccaggatagcaccggcggcaacgcgtcgatgccgtcgagcacgcggatcagcatgttgaaggtggcgaacgcgatcgcgatcagcatcacgcggccggtcggcgtgcggcggacggcgagccacagcgcgaggctgatgttgacgatccccagcgccgcgttcagccgcaggcagaaccacgtgaaggtcagcaggtcgccgcaggcggcgccggccacgccgacgaactcgagcgcgaggaatgccatgtagaccgcgcgcaacggcagcctggcctgttcgcgccgggcgaccgtcaggatgaagacgatgaagcaggcgatcgcgaggtacacgaagatgatttcgccgcgcgccgaccactcgcgcagcgcgggcggcagcgccatcgccgtataaccgcggtaggccgcttcgaacagcgtcgtgcccagcgcaagcccggccagtacgtagaacatgccgctgcgcgaaaagaacccgatcagcagcgcacaccacacgagcgcgagcagcccgccgaagaaaccgaagtcccacatcgtcgcgcgccgttccagcgcatcccatgccgcacgggtgaatgccgccggcgcgagccgcatctccttgcgcgacgtgacgcggatcagcacggggatgcttgcgccggcgggcagcgtgacgtcgagcgtcgggtagcgcgacggcggcccggccgcatcgccgccggcatcggcggccgggaagcggccgtcgagcgtccaccggccgttccggccgacatagaagtcggcatggtcgacgcgcgcgtcgcgaatcgccagcaccagcggccgagcggcactgtcacggttgaccagcgtcgcgctgacccaccatgccgaccgcgaaaactcgatgttgaacgagggcgcggtcgccgtggacgcatcgtgcggccgatcggcaacgcgcgcggcgacctgttcggcggtcatcgtcgtgctcgcgtcctcgaacaccgacacggcttccagttgcgcggggttcggcgtcgctgccgcgcgggccgtcgcgcaggtgacggccagtgcgatcagaagcagcagcaccgcgcgccatccggctgcccaagccgcgtcgcgactacacatcgggatgatgcccgccgggtgtgggcggtgcgttgaccgcatggcgctggcgccgccagtcggacggcgtgatgccgaagcgttcgcggaacgccgtcgcgaaattgccgggcgtggaaaagccgatttcctcggcgatgtcgccgatccccatggacgtctccgcgaggaaatgcatcgcggcgcgcaggcgcgtgtcgcgcaggtactcgaacacggtcaggccgagctggtcgcggaacacgcgcgacagccgcttttcgtgcgtgccgacctgccgggcgagatcctcgagcgccggcggatggcgcaggtcgcgcagcaggacctcggccgccgcgcgcacgagggccgcctccgggttgtcgggcatctcgggcaggtgcgcgaacggctggctgcgccgcgcgcgcttcaggtggttgcggatccgggccagcacttcggtcggctcgaacggcttgacgatgtagtcgatcgcgccggtttcgagcccgcgatgcgatcctcgagatcgcccgcggccgtgaggatgatgaccgggatggactgcgtcgacggcgtcgacgccagcagccggcacgcggcgaagccgtccatgcgcggcatgcggacatccatcaggatcaggtcgggcgcgatcgcctgggcgcggtgatacgcctgcagcccgtcgaacgcgacgctgatccggcaccgcgcggcccgcaggatttcggtcaggagccgcaggtcgttcgggcgatcgtcgacgacaagaatatgggcgtcggcgagatccggcgtggagcgaagcgacgccgggctggacgagcgggatgacatggtggcggacgcggtggaagggtggtcggtcggattgaaagcttcgctttcagcgcgattgttgcgaaaaattatatgtcgacaacagtaccgattgtgaggattccgtgcggcccgtgtgggcatattcggcggggcgccgcgcggtttcggcaccggcgttccgccgaatggaataggagtggaaaaacatgccgaagtgcatttttaatatcggtctttatttccggattttatcggttgacgaatcgaattggcccgcagaatgaattcgagcgggttgtgtcgagagacgatgcctttcagtgtgaagttgatgcactgaatcgacgctcgcccgattaatgtctttttgcggggtggtcaagatttatccggatgaaaaccggatttcgggcgtgaatgtatgaatgtaaataccgtccgctcggggaaagtttttccgctccagaaaagatgcgtttgaacggatgaccgcacactagccccggcgcggctggaatcggttcttcgaggggaacggttttgcaaggattcctgccgctgccctattcagatgacgcgatattcaatgtgacatcgaatgatggcaattctcaggatgtgggaatgcgatgacggacaagaaaattggcacgagggtaatacaaatttcataattttccgaatgagtgcgtatacaagataagcggaaagattgtgaggttggtcagggtgtgacgcatcgaccaaaaaatcgtcaagaaaattcgaccgattaaatcgatgcgggggcgttcggcaagtcaggcgctatttccggaaatccggaaaagcgtttgactgccggcggagaaagtgagcggctgcgcgcgcagcccggcggtctgatccgtccgggtgcgatcacgcagcgcgttctcgaatcaggcgggcacgaaaaacatgaacgcgacaggcatggcaggtcaacgcaccggttcgagcgaaccgggtgcgcatgcttcatacccggggactactcggcgtcatcctcctcctgaatgaatcgtgacgggccgccccggggttcgggtcggcatccgtccatccggcgtctgaacgacgccttcccatgaaattcgaggtcgccgccggctcggcgcgacgacgcgcgcatgcggattcgcgatgcgtggggtcgcgcgtcgccgttttccgcgcgacatcggcttcgatgaaccgataaccggcgagtgccgccgcgccgcgtgccgatgcacgcgtgcggcgtgcagtcgtgcgatcgcccgcgcgatcgcgattaccgagcagtgttgttcgatcgtttagttagccatccaaagtgaagcgcgaagcgtcgcggcacggacgaggtggcaggccgatgcgtcatcgcctgccgtcgcgtttgctgccgcgtcatccagcacatgagaaccgagggaacacaagatgaacaagtcgttcaagtcgatctggaacgaagcactgggggcctgggttgcggcttccgagcttgaccgtgcgcgcggcaagcgtgtcgcgtcggcgagcggcccgcgcgagcatgcggcgaacgagggcgccgcgcgacgcgcgggctgctttcggcgccgtcgccgcgacggctggccgtgctgatggcgtccacgtatcttgcgttgttccatgcgggggcgcacgcgcaatacgcgccggacggcggttccgcgaccggcggcgtgacgtcgatctcgatcggcgtcgggtcgagtgccgcgcagcagaactcgaccgcgctgggcaacctgtcgacggcagcaggcgtttccgccacggcgctggggccgggcgcgcatgcgatggcagacggttcgacggccgtcggcatcaacgcgcaggcgaccggcgtcaacagcgcatcgctcggcgtgcaggcgatcggttcgggcgcatattcggtggcggtcggcaatctgtcgagcgcgacccaaagcggtgcggtggcgatgggcagcggcgcggcggcgaccggcgtgtccgccgtcggcctcggcaacaatgcgctggcgtccggccagtatgccgctgcggtgggtctcggtgcgagcgcggtcggggcccagagcgtttcgctcggctatgcgtcgcatgctaccgacacgggcgccgtcgcgctcggcaaccagtcgacgggttccggcgcggccgccgtggccgtcggcagcggtgcgctggcgagcggcaattcgggtatcgcgatgggcgtcaacagcggcgcgaagggtgggtcgtcgatcgcgatcggctggggcgggacggccggcgtaccgggatcgggcacgcagtcgcttggcgtgagttcgatcgcgctgggttcgaagacgacggccggtgccgatcaggcaatggcgtacggcctgagcgcaaatgcgtcgggcgtcagttcgatcgcgatgggtgtgcagtcgaccgcgacgcagcagtttgcggtcgcgctcggcaatctcgcgctcggcagcggcatctcggcgaccgcactggggcccggtgcgacggcgtcggcgacgaatgcgacggccatcggcatcaacagcgtcgcggccgcggcgtccaccgtggcgatcggcgacagcaattcggtcgcggccgcggcaggcgcggggtcgatcgcaggcggcaacagctcgaaggtgttgagcggtgtcggggcggtcgcgctcggcctggggcagacggtcagcggcaacggcgcggtggcgatcggcgacccgagcaccgcgatcggcaccggcgcggtcacgatgggttcgaacaacaccgcgaacggcgacggcgcggttgcgatcggcaattcgaacctcgcgcagggcacgggctcgctcgcgctcggcaatacgtcgacggcagcggcagccggtgcggtggcgttcggcgcgtcggccgtggcgaacaatgcaaacgacgtcgcgctcggctccgggtcgacgacggccgcgccgaatccgacggcgagcgcggtgatcggcggcgtcacctacaacttcaacggcaccaacccgaccagcgtcgtcagcgtcggcgcggcgggtaccgagcgccagatcaccaacgtcgcggccgggcgcatcaattcggcgagcacggatgcaatcaacgggtcgcagctcgatgcgacgaaccaggcggtgaattcgctgtcgacgtcgaccgcgtcgagcgtcagttcgttgtcgacggggtgtcgtcgttgtcgaccgggctgtcgtcggccaatagcgcgatcacgtcgttgtccacgtcgacgtcgaccgggatcggctcgctgtcgacggggttgagttcgaccaacagctcggtgacttcgttgtcgacgtccacgtcgaccggcctgtcgtcggccaatagcgcgatcacgtcgctgtccacgtcgacatcgaccggcattacctcgctgtccacgggcttgagttcgaccaacagctcggtgacgtcattgtcgacctccacatcgaccggcctgtcgtcggccaacagcgcgatcacgtcgctgtccacgtcgacgtcgaccggcattacctcgctgtccacgggcttgagttcgaccaatagctcggtgacgtcattgtcgacctccacatcgaccggcctgtcgtcggccaatagcgcgatcacgtcgctgtccacgtcgacgtcgaccggcattacctcgttgtccacgggcttgagttcgaccaacagcaccgtgacgtcattgtcgacgtccacgtcgaccgggttgtcgtcggccaacagttcgatttcatcactgtccacgtcgacttcgaccggcctgagctcgaccaacagttcggtggcttcgctgtcgacttcgacgtcgaccggcatcagctcgttgtccaccggcctgagttcgaccaacagcacggtcacgtcgctgtccacatcgacgtcgaccggcatcagctcgctgtccaccggcttgagttcgacgaacagcacggtcacgtcgttgtccacctcgacctcgaccggcgtcgcttcgctgtccaccggcctgagcacgaccaacagcaccgtgacatcgctgtccaccgcgacgtcgacgagcatcggctcgttgtccaccggcctcagctcgacgaccagctcgatttcgtcgctgtcgacgtcgacctcgacgaccgtcggttcgctgtccaccggcctgtcgagcacgaacagcaacctgacgtcgctttccaccgcgacgtcgacgggcatcggttcgctgtcgaccggcctcagctcgatcgcgtcgaacaacggcaatctcggcaacagcacggccggcgcgatcggcggcggggccacctacgacccgacgaccggcacgatctccgcgccttcgtacgtgacgtacaacagcgacggttcgacgacggtcaacaacaacgtcggctcggcgatcgacaacatcaacgcgcacggcatcaagtatttccacgcgaactccacggcgccggacagccaggcgctcgggctcgacagtgtcgcgatcggcccgaacgcggtcgcgaaggtggacggcagcatcgcgctcggcgccgggtcggtgtccgatcgcgcgacggtgccggcgtcggggaccatccgcaacggcagcgcgtcgattccgttcaacacgaccgaccagacgttgctgggcgcggtatcggtcggcgacgcgacgagcaagacgtatcgccagatcaccaacgtcgcggacggcaccggccagcaggacgcggtgaccgtgcggcaactggccggcgcgctgcagtcgttcgcggtcacgaccacgaagtacttccacgcgaactcgacggccgtcgattcgctcgcggtcggtgccgagtcggtcgcggtcggcccgacgacggtggtcaacggcgacaacggcgtggggatcggcaacggtgcgatcgtcgatgccaccgcgccgggcggcgtcgcgatcggccaggcggcaagcgccgcgcaggccgatgcgatggcgctcggcagcggcgcgacggccaccggcgcgcagtcggtcgcgcagggcgccaacgcggtcgcggcgagcgtcggcagcgtcgcgctcggttcgggcgcgcacgccacggcaaccgatgcgctcgcattcggggccggcgcgtcggcgacgctcgcgaacagcatcgcgctcggttcgggttcgctgaccaccgtcggcgcgcagacgaactacatcgcctacggcctgagcagtccgcagtcgtcggccggcgaaatcaacatcggcaaccggcagatcaccggcctcgcggccggcaagagcggcaccgatgcggtcaacgtgtcgcagctcgactcggtcgccaaccagttgacgacgctgatcacccagcgcacgtccaacctcggcgggtcgtacacgacgaacccgaccggcacgaacgtgccgccgggctcgacggggccgaattcgtcggcgggcggctcgggcgcggtcgcatcgggctcgaacagcacggcggtcggcaacgggtcgctggcgtccggcaacggttcgaccgcgatcggcgtcggctcgaccgcaacgggcaacgggtcgaccgcgatcggcacgggcagcaacgacggcgggcgctcgaacgtcgtcgcggtcggctcggcggagtcggcgcgccaggtcgtcaacgtcgcggccggcacgcagggcaccgacgcggtgaacgtgaaccagctgaacgcggtatcgaaccagttcacgcaatcgctgaacacggtcaacaaccagctcacgcagatgcagcagcagatccagcagaccgattcgatggcgcgcgacgggattgccgcgacggccgcgatggcgtcgatcccgcacatggaccgcgactcgaacttcgcgatgggggtcggtacggcgagcttcctcggccagaaggcgatggccgtcggcatgcaggcgcgcctcacggagaacctgaaggcgacgctgaacggcggtttcgccggcagtcagcgcgtggtcggcgccggtatgttgtatcagtggaagtgatccgtgcgcagcgaaccgtttcggcgtgcagcgccggaacggttcgcgctgaacgagaacgcatccgcatgcggccgcactgccgcgccgcatgcgcgatatcgaaccgattttcgggagtgaatcagtgaagaaaacttctcttgccctgctcgtgtccgtggtctcctggccgcctgctcgagcgcgtccgggccgacgttcaatgcatacgaactgcagccgagaaacggcgtgcggacgtttcgcgtcgattgtcacggcatcctgtcgagcgaaaagacctgcatgaaggtcgcgacgcgcatgtgcgacacgcagccggtccggctgctcgatgcggaggcgccgttccgcgacggcgcggatccgcggtcgatcgagttccagtgcggcgcggcacccgcgccgcttccggcgccggtggcggcggcaccggccgccgcggagaaggtcagtctgaccggcgacacgtacttcgcgaccgactccgcgacgctgacgcccgccgcccgcgcttcgctcgacgcattgttgagccgtcaggcggaccggcatttctcgttggtgaaggtgaccggctataccgactcggtcggctcggatgcgcacaatctggcgctgtcgcagcgccgcgcggaggcggtcgggacgtatttgcgcgagcatggcgtgaacgcggattccgtgacggccaccggaaaggggaggccgatccggtgggctccaacgagaccgccgaagggcgggcgagcaatcgacgcgtggagatcctgctgcagaagtagcgggtgggggccgcgagcaggccggcgaaggcggccggctcgcggccgcatcgtcgccatgatgatcaaggttgatcgcgcgcggcagccgatgccggctccgctgccgtcgcgctccgcgtcgatcatggcgaatcgggacagccggcgccggaccgaacgcggagcgtacgaccgccgggtttcccgatcctgtaccctgtccatgtctttcgtgcgttccgcggcggtcgtcggcatgacggccgccgtgccttccgttacgatgcgcccggtcgatcagcgccgtgccccggtcggcagcaagtcgatccggttgcagacctccaaggcaaacatggaaatcaagtggatcgaggatttcatcgccctcgctcaatatcaaagcttttcccgggcggcggagttccgcaacgtcacgcagtcgggcttcagccgtcgcatccagtcgctcgagcaatggatcggcgccgaactgatcgaccgcagcagttttccgccggtcctgacgccggcagggcggctgtttcgcgagacggcggaagacgtcctcagccgcctgttcgacacgcgggcgatcattcgcaccgagcagcgcatcgcgggcaagagcctgcagatcgcggcgggccatacgatcgcgctgaatttcctgccgtcgtggctcaaggcgcttgcgccgcatttcggcgaggtgcgggcacgcgtcgttccgacgaatgtccacgattcgatcctgatgctcgtcaacggcaactgcgagctgatgttcgcctatcaccatccggagctgccgctccatctggatccggtcaggtacgaacacgtgacggtcggcctcgacacgttgatgccggcctgccggcccaaccgccggtcggcgcccgcatttcgccttcccgggacgaagcagcacccgctgccgctgatctcctatacggacaccagctacttcgggcgctgcctcgcgttgctgctcgatcgcgctccggatgcgccggcgttgcagctgcactatgaatccgacatggccgaagtgctgaaaaagctcgtgatggaaggcgaaggcgtggcgtggctgccgcggagtgcgatcgccgccgagctggcggccggcgaactcgtgccggccgggccggcggcatggaacctcgaaatcgagctgcgcgtctatcgcgacgcgtccaatcgcagcgagttcctggagacgctctggcagcatctgcgcgccgaaccgtcgcggcgcggctagggttttccgccttatgcgagtctcgcataccgccatgatgcaccggcatcatggtctgtccggccgtccctaccattcgttccaacgacaaatgtgacgcgtggcccgcgtcgcgcggcccgtcgcctgccggcggtcgggcgtcacgcaaggacggatggacatgaaaaatcggcttacctcaagcatcgcaatcggcatggtcctcggcgtcgctgccggctatgcgtgtcacacgagcatcgcggacccgggcacgctcaagacggtcgcagggtatttctcgatcgtgacggacatctttcttcggctgatcaagatgatcattgcgccgctggtgttcgtgacgctcgtttccggcctggccggaatggacagcggcgaagacgtcgggcgcatcggcctgcgctcggttgcgtggttcgtctgcgcatcgctggtttcgctgggcctcggcctcgtcatggccaacgcgttgcagcccggtgccggcctgaacctggcggaacctgcgggcgaggccaacctcggcctgaataccgcggcactgaacgccagggacgtgatcacgcacgcgtttccgaccagcctgctcgacgcgatggcgcgcaacgacatcctgcagattctcgttttctccgtctttctcggcatcgcgctgggcgcgctgaagcacgatcagcgtgtcggcatcgtcatccggtcgatcgacggcatggtgccggtgatgttgcgcctgacgaactacgtgatgcgcgcggcgccgctgggtgtcttcggtgcgatcgcgtcgtccgtcgcgctgcgcgggctcgacgtgatctacacgtacggcaagctgatcggcgcgttttatctcgggctgctcgtcctctggacgatcctgatcggcgcgggatacctgttcctcgggcggcgcgtcggcgcgttgctgagggccgtgcgcgaacccgcgttgatcgcgttctcgaccgccagcagcgaagcggcgtatccgcgcctgaccgagcagctcgagaagttcggtgtcgacaagaaggtcgtcggtttcacgctgccgctcggttatgcattcaacctggacggctcgatgatgtatcaggcgtttgcggccctcttcatcgcacaggcgttcggcgtgcacatgccgctttcgcagcaggtgttcatgctgctgatcctgatgttgagcagcaagggcatggcgagcgtgccgcgcggatcggtggtcgtcgtcgcggccgtcgcgccgatgttccatttgccggcggccggcgtggccatgatcctggcgatcgaccaggtgctcgacatgggccgcacgatgacgaacgtgatcggcaacagcgtggcgacggccgtgatcgcgaagtgggagggtgcgcgcgccgcgcagccggacagcgccgcgttcgatccgcgggagctgaacgcatgacgcaccgggacatcgcaggcacgggacggacgttcggcgtggtcggcggcctcgggccgctgggaagcgccgacgtgttcttcaagctggtgaaggcgactccggcgtcgtccgacgaggatcacgtcgatctgatcttcgagcagcacccgttcaggggttcgggttcgggcagcgcggcgacgacggcgcgcaagctgtacgtgttcgacatgatccgcgcgttcgagaaacgcggcgtgacgaccgtggtgctgccgtgcttcctgagccacaccttcatcgacgaactgaaggccaatacgcgcctgccgatcgtggacatcgtcgaagccgttcgcagccacgtgcagcgcacgtatcccggcgccatacgcatcggcgtgctggcttcggaccatgtgcgggccgacgggctgttcgaacggtatttcccggcgccgcagttcgagatcgtccatccgcggccgcgcggcgatgtcgatcccgtcaccgaggcgatctacggggcggacggcatcaagcgcggcaatcttcgcggccggccggtcgagctgctgcgcgacgcatgcgaggatctggcggaccagggcgcgcaggtcatcgttccggggctgacggagatcgcgctcgtggcggacgaaatcgggccgctgcggataccgctgatcgattcgaatctcgcgtatgcgcagtacgcggtttcgacccgatgcggggcccgtgcaccggtattcaagatcggggtcgtcggtggcgtcgggccggccgcgacggtggatttcctggacaagatcgtgcgaaacacgccggcttcgcgcgaccaggagcacatcaagctgctggtcgaacagaatccgcagatcccggaccgcacggcgaacctcgtcggcgacggtaccgaccccacgatctcgctgtatgcgacgtgcaggcggctcgaggacggggaggcggatctcatcgcgattccgtgcaataccgcgcatgcgttcgtcgagcgggttcaaccgcacctcggcattccgatcgtaaacatgctgaccgtgacggccgcccatctgcgcgatgcgtatccggggctgcgcgaggtcggcgtgctggcaacgtcgggcacgatcgaaagcggcgtatacgaaaaggcgctcgaatcgtatggattccgacaggtcgcgccggcgccggcgctgcaggcgcgcgtgatggaagcgatctacggagagcgtggtgtcaaggccggctttacgaccggccagtgcaaagcggacatcggcgccgccgtcgacgcgctgattgccgacggcgtcgacgtgatcgttctcggctgcaccgagctgccgatcctgctgccgggccgcgaatatgtcgcgccgagcggtgtgcgtgcgacgctggtcgatccgaccgacgtgctcgcgcgccaatgcgtggcgtacgcgacggctgccggtgcttgagattgagcttgagattaagcggccgcgccgccttcgacgcggcggccgtcgggtatcggatgtgccgcgtggttcgggcggcgcaggcgtggatcagccggtgccggtcttgtgcgattccacgacgaccgcgcgcgtgacgaagcggtttaccgaggccgacaaaccgggcgcccggcagcgggcgccatgtcagtgtctgagcacgcagacggcgacgatttcgtatccggggtcggcatgcatgtgcgccgccatttccgcttcctcatacgaacgaaacgacgtggcatcttcaaccgccggtgccatgccgatatcgccatcctcggcggtgcacaggaactgctcgccggttttcacgacgtagacggacaacatgattccctccatcgtttgcagggaaatttcagtctagcaggccagaaaaggggcgcgggcggtttgcggcgccccgtttccgcgaggcggtcgccggagggtttgccgcgtcgcgtgtccgctagacctgcgacaggagcggaaagccgtgcacaataccggcatgcagaccccagatctcgaacacctcgtcaccgtcaccatgccctttggaaagtacaagggccgactcattgccgacctgcccgggccttacctcaactggctggcccgcgaagggttcccgcgcggcgaaatcggccggcagcttgcgctgatgcatgaaatcgaccacaacggcctgcgggacttgctggagccgttgcgcaaacgcggatagcgtcgctcggggccgaacggcttcggatgcggcaccgtcgctggcccacgcgcacctactgcgttgccattgctgacatagaatggaaagagtagttgacggcacaaaggggtgccaacatgagacgcctttatttcctcgtacccgatacgcagatggccaaggccatcgtcgacgatctattgcgcgcacgtatcatctggcgccatatccacgtcctcgccgatcacagcgtcacactcgatcagttgcccgaagcatcgttgctgcaaagcagcgatgtcgtgcatgcgctcgagcgcggcgtcgcgcttggcggcgcggcgggcgcactgatcggcctcgtcgcgctggtatttccccggcggaactcgtgatcgcaggcggcgccgttgtcgggttgacgctggcgggagcgggtttcggggcgtggaccgccgcgatgatcggcatcgccgagccgaacgcgcgactccagcgatttcgcgaggccatacaggaaggccagatcctgatcatggccgatgtgccggcattgcgagagcaggaaatcgaggagatggtcgccaggcactttccgacggctgacctggaaggcgccgagcccacgacaccgatcttccctgacgcgcgacagcaagccggcctgcccgatacccgggttcatcgacgcatttcgtcgagcgcacggccgcgcgcggagaagggcgttcgcacgttgcgcaggcaaccctgcttccgaatcgctcaagtgacgcaggcccgacgcgcgtgacgccctcggaaccgaagcgccgacgacgaagcgtcggcaaggaggtcgtatggaactgcacatgcaatcgcaccattgggcgcgtcggacgccggactgggtcgccgccgccgtggccggtctcgcaggcggtgcgctggtgatcgcgctggaattcgtctggtcgacactcgtgctcggctcgagcccgtggcaaccgacacacaagatcgcggcgatggtgatgggccgcagcgcgctcggccagatgacgcaattcaaccttgaaatcgtcgcgatggcgctgctgctgcactacgtgctcggcgcgatcatggggtgatgctcgccgcgatcatggcgcctttccgcctcgattcaagcgtgggcatggaagccgccatcgggctggcgttcgggatcgtcgcgtatgggtggaacttctacgtcatgacggccgtgttcccgtggttcgtctccgagcggggtgccgggccgttgctggccaacctgttgttcggcgtggttgcggccatcacctacggcaggctggagcgattgcgcaagcggaacgtggacgactgatacatcgcgtttcccgccgcgccgagcctgaccacccggcgttcgcgggagacacggaacccggtgtcggcggcgccggcgagtgatacgcagcgaggcggcctatggcccttgcgattgccctggtcctgatcatcctgttggcggtggggtttcactttgccagtccgtggtggatcacgccgatcgcgtcgaactgggtgcgcatggacgacatgctgacgatcacgctcgtcatcaccggtgcattcttcatcgccatcaacctgttcatcgtcgtcgcgctggtgcgctatcgccaccgcagcgggcatcgcgcggcctacgagccgcacaaccgccggctggaatggtggctgatcggcctgaccgccgtcggcgtggcggcgttgctggcgccggggctgttcgtctacgcggactacatccggccgccgcgcaacgtgctgcagatggaagtgctcggccagcaatggcaatggcgcttccgcttcgcgggccccggcggcaagctgggcacgacggacgtgcgctacatcagcaacgacaacccgttcggcctgaaccccgccgaccccaacggccgcgacaattacctgatcgagacgcccgaggtgcacctgccgctcaaccggccggtccaggtgctgacgcgctcgcgcgacgtgctgcacgatttctacgttccgccgttccgggcgcggatgaacatggtgccgggcatggtgaccaccttctggttcacgccgaccaaggcggggcgctacgacatcctgtgcgcgcagctctgcgggatcgggcactccggcatgcgcggcgtggtggtcgtggaagacgaagccgcgttctcgcgctggctggcgcagcagcccaccttcgcgcggcagcaactcgcccacgtgcaggcaacccccgccgctgccggcggcagcgcgcacgcgctcgccgaactgggcaagacgctcgcggcggccaagggctgcgtcgcctgccataccgtggacggcagcccgctcgtgggtccgacctggaagggcttgtacggcaagaccgaaacgatggccgacggcagcaccgcgaaggtggacgaagcctatctgcgcgcgttcatccgcgatccggcggcgcgggtcgtgaagggttctcgccgatcatgccgcacttcgacctgagcgaccaggaactgtcggcactggtggcatatatcgaggcgcaaggcgggccgcctccggccggtaccgcggccaggcaatagcggagcagaaaccatgacctatgcgcacaccgatcacgccccgcggagcttctggacccgctatgtctggagccaggaccacaaggtcatcgcggtgcagtatgcgatgacggccatcgcgatcgggctggtcggcctcgtattgtccgacctgatgcggctgcagctcggctttccgggcaagttcgccttcatcgacgcgaaccactactaccagttcgtcacgatgcacgggatgatcatggtgatctacctgctgacggcgctgttcctgggcggcttcggcaactacctgatcccgctgatgctcggcgcgcgcgacatggtgttcccgtttctcaacatgctgagctactgggtctacctgctggccgtgctggtgctggcggcgagcttcttcgtgccgggcgggccgaccggcgcgggctggacgctgtatccgccgcaggccatcctgccgggcacgccgggcgtcgaatggggcatcgtgctgatgctcgtgtcgctggcgatcttcatcgtcgcggcgacgatgggcggcctgaattacgtgaccaccacgctgcaggcacgcacgcgcggcatgacgctgatgcgcatgccgctcacggtgtggggcatcttcatcgcgaccatcatggcgctgctggcgtttccggcgctgttcgtgtcggcggtgatgatgctgttcgacaggacgctcggcaccagcttcttcgtgccggccgtggtgtcgatggggcagacgctcaagcatgccggcggcagcccgctgctgttccagcacctgttctggttcttcgggcatccggaggtctacatcgtcgcgctgccggccttcggcatcgcgtcggacctgatcagcacgcacgcgcgcaagagcatcttcggctaccggatgatggtgtgggccatcgtcatcatcggcgcgctgagcttcgtggtctgggcgcaccacatgttcatcgccggcatgaatccgtacttcggcttcttcttcgccaccaccacgctcatcatcgccgtgccgaccgccctcaaggtctacaactgggtgctgacgctgtggcgcggcgatatccacctgaccgtgccgatgctgttcgccatcggcttcatcagcaccttcgtgctgggcgggctgaccgggctctacctcggcaacgtgagcgtggacatcccgctgtcgaacacgtatttcgtggtcgcgcacttccatatggtgatggccgtgtcgccgatcctggtggtgttcggcggcctctaccactggtacccgaaggtgacgggccgcatgctcgacgacacgctcgggcgcgcgcacttctggatcaccttcgtcggcacctatgcgatctacttcccgatgcactatctcggcatcctcggcatgccgcggcggtattacgcgtaccagggctacagcttcatcccgcattcggcgcagacgctcaacacgttcatcaccgtcgtcgcgctgatcgtcgcggccgcgcagttgctgttcctgttcaacctcgcgtggagcctcgtgcacggccggcgcgccgacggcaacccgtggcgggccaccacgctggaatggcagacgccgcaaacgccgcccgcgcacggcaactggggcgcggcgcttcccgtcgtctaccgctgggcatacgaatacagtccgccggggcaagaggaagatttcgtgccgcaaaaccagccgcccgcgacggtgcctgaaccggcccacccggcgcttcaccccggcgaggcccacgaatgaccacgctgccgcgcccctttgttcacgacgcgcgacccggcttgccgaatgcgggccgcatcggcctgatcgtcttcatggcggtcgcgacgacgttgttctcgctgctgctgctcgcctatgcgatgcgcatgcgcgagcccgactggcagccgatcccgcatccggcgctgctgtggtggaacaccggcgcgctggcgctggccagcgtcgccatgcagcgagcccggcaactgaccttgcaccgcaccgcgtggctcgtgtgcggcggcgtgctggcggccgtgttcgtggccgggcaactgaccgcctggcacctgctgtcggctggcgggcagaccgttgcggtcaatccgtcgaacagcttcctctacctgctcaccggcctgcacggattgcatgtgctgggcgggctggcggcgtgggcggtgacgatcgcacagctccggcgcgtggacccgttccgggcccggcgcgtcatcgatctgtgcgcgctttactggcatttcctgctcgcggtgtggctcgtgctgctggcggcgatgtggtggctgaccccgggattgtcgccgccgtctgcgggccgctgtatggagccgcgccatgaccgcgcccacggcccccaccggatccgccgccgattcgcccgcggccccgcctgccgatgcgccgtccgccgacgcccggcccgacggctggcgcggcatcgtcacggactggtcggccgatcgcgaagccttcaaggtgccgtggggcaaggcgatgatgtggatcttcctgctgtcggacacgttcgtcttcagcagtttcctgatcggctacatgacggtgcgcatgtcgaccacggcgccgtggcccgataccgcgaaggtgttcgggctcagcgtgggcggcgtggaggtgccgttgctgctgattgcgatcatgacgttcacgctgatcagcagcagcggcaccatggcgatggccgtcaacttcggctaccggcgcaacgcgaggcccgccgccgcgctgctgctggcgaccgcgctgctgggcgccaccttcgtgtcgctgcaggcgttcgaatggagcaacctgatcttccgggaaggcatccgcccgtggggcaatccgctgggcgcggcgcagttcggcgcgtgcttcttcacgatcaccgggttccacggctttcacgtgacctgcggcgtgatctacctgctgctgatcgcgcgcaagatcctgcagccggggttcgccgaacacggcaacttccagatcgtcgagatcgccggcctgtactggcacttcgtcgacctggtgtgggtgttcatcttcgcgctgttctacttgtggtgaggcaggccatggaccataccgatcccgccgatcgacccgacgccgcgcacggccagcagcatccgatcggcctctacctgaagatctggggcctgctgttcgtgctgagcacgttgtcgtacttggtcgactatttcaacgtgcagggcctgttgcgctgggtactgatcgtcgtgctgatgatcgccaaggccgggctgatcgtgtcgatcttcatgcacatgatgtgggagcggctggcgctggtgtacgcgattctcgtgccgccgctgtgcctgctggtgctcatggtgctgatggcggccgaggcgcatcacacgttcgggatgcgggaattgtttttcggtgattccttcgcaggggatgaatgtgtcgcagcgcgacaggtacggtgacgggccgcggttgtgcgccgggcggcttcgcggcatcggaggatgccggtcatccggccacgcaaacatcgaggagggcaagatgaagttttcacgccgacgttttatcgctgccaccaccgttctggcatccgcgctggccgttgggcgccgcgcggccgcggcagatgccggggccggtgccgtgcaggaaaccgatgcaaacgcccaggccctcggctacaagacggatgcaagccgggtcgaccatgcgaaattcccgaaatttcaggcgggcgaggcctgcgcgaattgtcagttcttccagggcaagaccggtgcgaccacggcgccgtgcaccattttcggcggcaagcaggtcaatgcgaaaggctggtgcggcgcttacgcgaaaaaggcgtagcagggcagggggcgagcgggtggccgggatacgtgatgcccggcccaccccttgactgatcggactcgagccaagcacccggcgcgacgcgaaatccggatggcgggcaatggtcagagatcgccgcgcacttcaccggttcccagcgcggtccgctgccggttgacttccgcccagagctcgtcgctgtcgtcgttgcgcagcaggaccatccagtccagttgatcgtcggtcacgtcgaagtattccaggatctcgcggcgagccgcatcgacgaactgcgcgaattccggggttgcctgggcccgtgcgtgcaacgcgtcgtattccgcatcgtccgcgccgccgccgtgctcgtcgatgtagcgcgagatccactggtctatttcgcggtcgtagtcggcttcggcgcgcatcgcttgcacggccgtgtggaaatccagttgggcaaacgcggcgatcgccgccgttgtcgcctcgtcgaaggtagtcgtcattccatttctcatgttgatcagcgcgcatcatcgcatgggcggcgcccgggcaggtgcgtcgaatccggatggcgcaacacacggcttgcgtgccgaagtccgacccgggcaacggcaccattttcggaacgtcgatgcctccgcggatatcgcgtcggcggtatgttaccggctcgaaacgacccggagcggtcagccggtcaacgcggaatcatcggctgttggaaatcacgtcgctcatgtattgattcaggtcgcgaaaatcctggacggtccaggcgtgcggcgccagcttgacgccgttctccctcaaggttctcggaatcaggtccccgttcgggcgaagtattaccgacgaaacgatgacgcctggataatcatggagccgctttttgaacgcggcagtggtgaggtcaggcgtggggattgcttttcctggccaatggcccggtgcccttgatatctgcgccatggcacatcgcgcatctctgtataaagagatttttcccgttgatgttttgcgagaaggcgagtgaaggctgagtcaacacccacgctcccagcgaagtgatgagcaatgcttttgctttcattttccttgtcgtatcacgcggattgccgggtcggggagtataaatgcgtcatcgcggaatggccgcgcctggctgaaccgggtcggacggccgggcgtccgtatcgctcctgcagcagtcccggccccaaccccatcccatgccgccctcagggtcgtcatggaaaactgtatgaatatacagtatagtgtccgtcgaaatcgggccgcacaggtgcaacccttgcggcgcgtgcgccgcgcctgcgggcatccgccgcagcgttccggcaccgggcactctggttaactcattcagacgggcaggcaaattgtcatccagcaatctgatccgcattcgcggagcacgtcagcacaacctcaagaacctcgatctcgacctgcgcaccggcgagatgacggtcgtcaccggcccgtcgggctccggcaagtcgagcctcgtgttcgacacgctgtacgcggaaggccagcggcgctacgtcgagacattcagcgcgtacgcgcggcagttcctcgaccggatggaccgcccgcaggtcgagcgggtcgacggcgtgccgcccgcgatcgcgatcgatcagaccaacccggtgcgcagttcgcgctcgaccgtcggcacgatgaccgagctgaacgatcacctgaagctgctgtacgcgcgcgcggccgagctgttcgaccgcaagaccgcgcggcaggtgcggcacgacacgccggagacgatctacgcggaactcgtcgcgcgcacgcaggcggacgatccgcgtgtcgtcgtcacgttcccggtcgagctgcccgaaacggcgtccgatgaggaagtcgcgcagtggctgtccgcgagcggttacacgcgcgtgcaggcgcagcgcgaggtcgcgtcgcccaccgggccgcgcaaggtgctcgacgtggtggccgaccgcttccgcgtgcagcaggccgacaaggtgcgcgtggtcgaggcgatcgaggcgtcgctgaagcgcggcggcgggcgcgtgaatgtgtacgtgctggcgccggaagcggaaaacgcgatcgccgagccgcaggtgtggcgcttctccaccgggcttcacgatcccgacagcgacctgcgctacgcggagccgcaggcggcgctgttctcgttcaattcggcgtacggcgcgtgcgaaacctgccgcggcttcggccgcgtgatcggcgtcgatctcggcctcgtgattcccgacgcgcgcaagacgctgcgcggcggcgcgatcaagccgatgcagacgcccgcgtggaaggagtgccaggacgacctgatgcgctacgcggcgaaagccggcatcccgcgcgacacgccgtgggccgagctgtcggacgccgagcgcgactgggtcgtcaacggttcgccggactggaacggcaagtggcagagccagtggtacggcgtgaagcgcttcttcggctatctcgagtcgaaagcgtacaagatgcatatccgcgtgctgctgtcgaaataccgcagctacacgccgtgcgacgtgtgcggcggcgcgcgcctgaagacggagtcgctgcagtggcggctcggctcgaaagagaacgccgacggcgtgctcgcgccggccggccgcttcatgccgcgcggcgtcgactggagccgcgcgcagctcgaggcgctgccgggcctgaccgtgcacgacctgatgctgttgccgatcgagcgcatccgccgcttcttcgacgacatcagcctgccgagcgcgctgctcgacgatgcattgaagctgctgctcgccgaggtgcgcacgcgcctgaaatacctgtgcgacgtcgggctcggctacctgacgctcgaccggcagagccgcacgctgtcgggcggcgaggtgcagcggatcaacctgacgacggcgctcggcacgtcgctcacgaaaaccctgttcgtgctcgacgaaccgagcatcgggctgcatccgcgcgatctcacgcggatcgtcgaggcgatgcagcggctgcgcgacgcgggcaatacgctggtggtggtcgaacacgatccgtcggtgatgctcgcggccgatcgcctgatcgacatggggcccggccccggcgaacgcggcggcacgatcgtctacgacggcacgccgggcgacatccgctccgcgcacacgctgacgggcgagtatctcggcggccgcaagcatgtcgcgcatgcgtcgaactgggcgcgccgggtggtcgacgcgaatacgccgcgcatcgtgctcgaaggcgcgagcgaacacaacctgcgcgacgtgacggtcgagattccgctgcagcggctcgtctgcgtgacgggcgtgtcggggtccggcaagtccacgctgctgcaggacgtgctctatccggcgatggcgcggcaccacggcaaggcgaccgagtcgccgggcgcgtaccgcagcctcacgggcgccgaccaggtgggcgacgtcgtgttcgtcgaccagtcgccgatcggcaagaccacccgttcgaacccggcgagctacgtcggcgcgttcgacgagatccgcaagctgttcgcgaaggcgccgctcgcgctgcaacgcggctacggcgccggcacgttcagcttcaactcgggcgacggccgttgcccgacctgcggcggctcgggcttcgagcacatcgagatgcagttcctgagcgacgtctacctgcgctgcccggactgcgacggcagccgctaccgcgcggagattctcgaagtgcgcatcgagcgcgacggccgcgcgctgagcatcgccgacgtgctcgatctcaccgtcagcgaagcggccgcgttcttcgcgaccgacgccgaggtgctgcgcgtgctgcagccgatcgtcgacgtcggcctcgaatacgtaaagctcggccagccggtgccgacgctgtcgggcggcgaagcgcagcgcctgaagctggccggcttcctcgccgaatcggcggcggccgtgaacggccgccgggtcgtcacggaagaggcgcgcatcgcgcgggcgaagctgttcatgttcgacgagccgaccaccgggctgcacttcgacgacatcgcgaagctgatgcaggcgttcggcaagctgctcgcggccggccattcgctgatcgtgatcgagcacaacctcgacgtgatccgcgcggccgactggctgatcgatctcggcccggaaggcggcgacggcggcggcctcgtgctgtgcgcgggcacgcccgacgacgtgaaagcctgcgccgaatcgcataccggcgtggcgctgctgcagtacgagcgcgcgatggatgccgacatggcgctcgccgacgaaggcaagccgctgcaggccgtgctgaacgcggcgcgcgagcggcgtgcgatcgaaggcgaggacgtcgtgcggatcgtcaacgcgcgcgagcacaacctgaaggcgcttgacgtcgacatcccgcacggcaagttcaacgtgatcaccggcgtgtcgggttccggcaagtcgacgctcgcgttcgacatcctgttccacgaaggccagcgccgttacctcgaatcgctgaacgcgtatgcgcgctcgatcgtgcagccggccggccgccccgaagtcgacgcggtgtacggcatcccgccgaccgtcgcgatcgagcagcggctgtcgcgcggcgggcgcaagagcacggtcgcgaccacgtccgaggtgtggcacttcctgcggctgctgtacgtgaagctcggcctgcagcattgcatccacgacggcacgccggtcacgtcgcaatccgtcgaatcgatcgccgcgcagttgctgcgcgatcatcgcggcgaacacgtcgggctgctcgcgccgctcgtcgtgaaccgcaagggcgtgtatacggatctcgcgaagtgggcgaaggcgcgcggcagcacgcatctgcgcgtcgacggcgagttcgtgccggtcgatccgtggccgaagctcgaccgcttccgcgagcatacgatcgagctgccggttgccgatatcgtcgtgtcgcccgacaacgaagccgaactgcgacgcgtgctcgacgagacgctcgagctcggcaagggcgtgatgcatctgctcgcgccgctcgacgggctgcacgacgcgatgcagaacgatcattcgaccgcgcgggtcggcacggtcaaggtgctgtcggtcaagcgtgcgtgcccggtgtgcggcacgagctacccggagctggacccgcggatgttctcgtacaacagcaagcacggctggtgcacgacctgcgtcggcaccggcgtcacgctcacgcgcgaacaacgcgccgcgtacgacgacacggtgctcgccggggacgatcgcggccgcgagcagacgctgccgtcggacgaacaggaaccggaaggcgtcggcaacgagccgtgcccggattgcaacggcacgcggctgaacccgtccgcacgggcggtgacgttcgacgcgcacccgatcgtcgaggtcgcgcaatggacggtgtcggacacgcgccgctggatcgacgggctggaactgacggggcgcgacgcgcagatcgcgcgcgacatcgtcagcgagatcggcagccgcctcgcgtttctcgaggaagtcgggctcggctacctgagcctcgaccgagcggcgccgagcctgtcgggcggtgaagcgcagcgcatccggctcgccgcgcaactcggcagcaacctgcagggtgtctgctacgtgctcgacgaaccgacgatcggcctgcatccgcgcgacaaccagatcctgctggatgcgctgcgcaagctcggcgacaagggcaacacgctcgtcgtcgtcgaacatgacgaggacacgatccgccgcgccgatcacatcatcgacatcggcccgggcgcgggcaagcgcggcggcacgctggtcgccgagggcgcggtcgccgatctggccgcgcagccggattcagtgacgggccgcctgctcgcgcagccgatgacgcatccgctgcagccacgccgcagcgtgagcctgccgggcaagaagggcggcgcggccgtgccggaagcctggttgaccgtgcacggtgcgcggctgcacaacctgcgcgacgtcacggtcggcattccgctcgcgcggctcgtcgcggtcacgggcgtgagcggctcgggcaagtcgacgctcgcgcgcgacgtgctgatgacgaacctgctcgacgcggtcggccgctcggtgctgtcgtcgccggccacgcgccgcgcgcgcaaggccgcgcagcaggacacaccggccgccaaccgtcgttcgagcgtgctcgcgcgcagtgcgccgcggccgtcgctgaacgtcacgcatgcgtggcagggctgcgaatcgctgagcggctgggagcagatcgaccgcgtgctcgaagtcgaccagacgccgatcggcaagacgccgcgttcgtgtccggccacctatatcggcgtgtgggacacgatccgcaagctgttcgccgatacgctggaagcgcgtgcgcgcggctacacggcgtcgcgcttctcgttcaacaccggcgacgggcgttgccccgcatgcgaagggcaaggcgtgcgcacgatcgggatgagcttcctgcccgacgtgaaggtgccgtgcgacgtgtgccacgggcagcgcttcaacccggagacgctcgccgtcacgtggcgcggccggaacatcggcgacgtgctgacgatggagatcgacgaggccgtggagtttttgcgccgatctcgaacatcgcgcatccgttgcagctgatgaaggatgtcggcctcggctacctgacgctcggccagccgtcgccgacgttgtcgggcggcgaggcgcagcgcatcaagctcgtcaccgagctgacgaaggtgcgcgacgacatcacgcggcgcggccagaaggcgccgcacacgctgtacgtgctcgacgagccgacggtcggcctgcacatggcggacgtcgcgaagctgattcgcgtgctgcaccggctcgtcgatgcggggcatagcgtcgtcgtgatcgagcacgacctcgacgtgatcgcggaagccgactggatcatcgatctcgggccggaaggcggtgtgggcggcggcacgatcgtcgcggcggcgccgccggaagcgctcgtgcaggtgcgcgcgagccatacggggcaggcgctcaagccggtgctcgcgcgaacgggcacgggcgaagggaagccgagcgcgagggagaagcgcgggtagggtgagcgcggcacttagtgttgacggcaccggcgccaggggattgcctcctggttaacgggctcggttctgttctttcaagccgtggggtaatggctccggtgcggcgccgttaccccgcttccgatacgcgaagcctcgcgctatcggagcttcgttttctggtgtcaaccggcgccatccccgcatgcggtgccgtcatgtctgtccgcggctcgctcgatcgcgtgcccgtcacttaaaacacattccccacgcgttttcgcgctgtcgcatccattccgtggtcgggttcggctgcgcgtcgaactgttgcgccagaccggccagcgtccgctcgcctttagcgttgcaagcgcagcacttttgcatcgaaccccgtcgggtgtgaccgtcgggttctcttcttcatcgtccaggttcctgggccggcattatcgcgggccaacggatcgagcgttccacttacacacctgcccggatttgcgaggccacgcctgaatcaatcgcgaattccattatgtgtgtgcgcgctatcggttttgatccgcgcgtcatattcatagaagaaatgaccgcaacggggtagtcgcacgttctccataatcgacattcgagattacctgcctattcgacgcattttcatgaaagtttgaatccggtcagcccggccattcgcgaggttgagttcgatgtcgcgtttcctttcgatccccgataaaaacccgctcgccaaagaggcgagcgcgcgcgttttggtcgatggtgccgtgctggtcgtgcgtcatgcctgccgacaggcagattgggcagatccgggacgacagtacgcggcgcgtttaccaccagacagacccaatgacgaaggatacgaaagtgagcaatgtccgcattgatcatattgccttcctgacaccgggcaattacgccggtgaagacgcggcggcgggattcgagcagacgctcgaactgttcggcgcgggcgaagcgctcggttacgacagcgcgtgggtgcggcaacgccacctcgagcgcgccgtctcgtcggccgccacgtttctcgcggcggcgagccagcgcacggcccggatcggattgggcgccgcggtcatccagatgggatacgagaatccgttccggctggccgaggatctcgcgaccgtcgacgtgctctcgcgcgggcggctcaatgtcggactcagcgcgggcgcaccgaatcacggcgcgctgctgggcgagcggctgttcgacaccgatccggatctcgtcgacttctcgcacgcgcgtgtggcacgcctgcgccgcaatctcgccggcgactggctcggcgacgacgacacgttcgtcgaatcggcagcgggccgggtccggccgcgcgtgagcccgtttgcgcccggcctgacggggcgactctggtacgggggcggttccaggcgatcgatcgagtgggccgccaggaacggcttcaacctgctgatcggcaatataaccacgggcgagggcaccgatagccatatcgacgcccagttgcggcaactggatctgtatcgcgaccattggcatgaagctcacgctccgcggatcgcgctggggcgcgtgatcgtcccgaccgacggcgcgagcgcgaaggagcgcgaacgctatcgcgcatttgccgacgcgcgtcatgcccgcacgctggcgccgcagggcgagcggcgcacgctgttcgcgccggatctcgtcggtagctcggacgagatcgtggagcggctgctggccgacccggtggtcggacaggtgcgggagctgcgcatcgaattgccttacgacctgccgttcgagaactaccggcagattctcgaggacttcatcacgcgtatcgccccggcactcgggtggcagccggttgaccggcgcgagcccgccgcggcctgatgcgatcgacatgacattccatcgaatggcgcacgtgatcgaagtcggcgacggaccggatgccggcgggcacgctgcaccttcgatctcgttgcaactggaccgaacatgacaaccgcttctccatcccggctcgcggcaatcggccgcccgcgccgcttcggcaacaagcagacgcatccggtacgccgcttcggcggcatcgcgatcgccattgcgctgcatctcgtcctgatctgggcgctcgtgaacggtctcgcgacgcgggtcgtccagatcgtccagcaaccgatcgaggcacgcatcatcgcaccggtgaagccgccgcctccaccgccgccaccgaagccggtcgaaaaggtcgtgtcgaagccgcgggtgacggcgccgccgccgccgttcgtgccgccgcccgaggtgcacgtgcaggccccgccgcccgccaccatcacgcatcaggacgtaccggtccagagcgcaccggtgcacgaagcgccacccgcgccggcgccggtgccggttgctgccggtgaatcgcgagattggcgtggtctgcccgaattcggacgaagtccggtcgtcgatcgtctacccgccggaggcgcaggacaacaacatcacgggtgacgtgaccgtcgaattcaccgtcgatccggacggccgcgtcacgaacctgcgggtcgcgcagccggccgacccggtgctcaatcgcgcggcgctcaacgcggtcaagcgcttcaactgtatcgcccaggggcaatccgtgcgtgtgcgggtaccgttttccttcaacctgaactgacggggaaggcaacgcggcagacgccgcctgcttcccggatcgatccgaaatagatatggagtgcgtatgagaaagcattttcgggccgcgctggcggcaagcctgatgatcgccgccggcgtgagcggcacgctggtcgccccgcaatccgtgcttgcccaggagaaggctgcggcacgggtcgagacagcatccggcgcagcgccgatcgtggcggcgccggctgcgtcgaacggatcggagcgcccggtgccgccgcccgaacccgcgacgtcggccaccgtcgagaacccgtacggcctgggcgctctgtgggcaaacggcgacttcgtcgcgcgtttcgtactggggctgctcgtggtgatgtcgctcggcagctggtacgtcatggtcaccaagttcatcgagcaggcgcgcgcgaacggccgcgcgaagtcggccgacgagcaggtctggaatgcgccgacgctggccgagggtgccgcccagctcgacgatacgtcgccgtttcgcttcatcgccgagaacgcgatcgaggcgggcgaacaccacgacaccgcgctgctcgattcggtcgaccgcaacacctggatcgagctgaacatcgagcgatcgatcaccagcgtgtcgaaccgtttgcaggacggcctggcgtttctgggcacggtgggctccacagcgccgttcgtcggcctgttcggcaccgtgtggggcatctatcacgcgctgacggccatcggcatcgcgggccaggcgtcgatcgacaaggttgccggcccggtgggcgaggcgctgatcatgaccgcgatcggcctcgcggtggccgtgccggccgtgctcggctacaacttcctcgtgcgccgcaacaagtccgtgatggaacgcgtgcgcgatttcggcgcgcaactgcacacggtgttgctcgcgggcggcaggcgcgcggcgggccgcatcgcgacaccggcggcacagtcgccgcaggcgctggcggttcagtcgtaggcggggcgcgtcatggcaatcagtgtcggcggtgacgacaacgacgatgtgatctcggcgatcaacacgacgccgctcgtggacgtgatgctggtgttgctgatcatcttcctgatcacgatcccggtggtgacgcacacgatccaggtgcagttgccggcggagcgcgtccagccgctgcagacccagccgaaaagcatcgagatcgcggtgaaccggcagggcgacctttctggggaaccgagcatgtgaaccttccgacgctggtgtcgcggctgaaggagatttcgacgcaggcgccgcagccggacgtgcacgtgcgcggcgatcaggcgacgccgtatcagtacatcggccgggtcgtcgcggcatgcgagcgggccggggtcgtcaaggtcgccttcatcacgcagccgcccgcgcgcgggggctagggagttcgaacgatgggtatgaacgcaggctccggagggagcaaggacgagccggacgtgatggtggacatcaacaccacgccgttgatcgacgtgatgctggtgctgctgatcatgttgatcatcacgatcccgatccagatgcactcggtgaagatgaacctgccggtggggaacccaccgccaccgccgcatccgccccaggtggtgcagatcgacatcggggcggacggggccgtcaactggaacggcgcggcagtgagcggcggggccgcgctggacgcgaagttccgcgcggtggcggccgaggcggaccaggacgagatccggctgcgcccggacaagtccgcaccttacaaggcggtggccgaagtgctggcctccgcccagcgcgaaggcgcgacgaagatcggcctgatcggcaacgagcagtacgtggagtgagcggctcgaaagaacgatggcgcggatcgagtcgtatcccgccgggtcgcacgcgatcgcgcgatcctctcgggtgccgctgcacgcgcaatcgccgcactgtcacgcaacttcacgcaaccccgcgtgaatcgcattcgccggccgggcaacgcaaacgtgttgtccaggcccggcgctcccgcacgagcagatcacctgccacgctgcaaactagtacgccgggcgaccgaccatccattcgcatcaagaaaccgacgcgttcctcctaagccggccacccccatcagcgaagactgctcgaagcggagcagggccgccgggctgcgatcgttccgtcatcgcaatgatgtcgacatcgtcacgatactttccggcccatcggttcgaacatgcaatgcgcagcttgtcgagcgaaatcgatatttcacaaacgtgcgcatattccttttcattattcaaatcgggcatcgtcaatatcaaccaaattaacgggtgctatttccattcgccacgcaatcgcaacattttctgcgtgattgcgtaatcgtgcgcaaggtcgctaattgtcggatgaattgataaatgaaaatgcgtatttgttatttaacaaactattacaccaggaggatgattcgtcacgcactgatatcaaaacaaacgagaagcgtgacgcgagaatgaaacgacacttcgcggcgcgctgaaatgagggccttgaagtggtttatcagagaaacgacattgcgcgcgtgaggatccccgtcgccgctcgctggcgctggccgcctgctggattaccgccggcagcgccgcgtgggcacaaggcacgaagccggaaccggcgcctgccggcgatacccgggacgtcgtcgtcaccgttcaggacgtcgtcgtcacgaccggcacgcgtgaaagcgcgcggaaggtgcgcgatgccgccgccccggtggaagtgatcagcggcgacgcgctgcggcgcaccgggcagggcaacctgcgcgacgcactcgtccagctctcgccgtcgatcgcgcgccaggcgatgcgcggcgatgcgggcaacctgaccagcgcgctgacgctgcacgggctgagccccgattacgtgctggtgctcgtgaacggcaagcgccgccattcgaccgcgaatgtgtcgctgaaccgcgggccgcagcaaggatcgaccggtgtcgacgtcgacctgatcccggtcacggcgatcgatcatgtcgagattctccgtgacggcgcatccgcgcaatatggctcggatgcgattgccggcgtgatcaacgtcatcctcaagtcgaattaccagggtggcgaggtgtcgaacacgaccggccagacctatcagggcgacggcctcgcgcagaacaatgcggccaccatcgggctgaggctcggcgatgccggttatgtcgacctgagcgccgaatacaaccggcagaatcatacggtgcgaaccgacgccgatccgcgaaccggccggaacgacaacctgattctcgggtcgccttccagcacgcgggaatcggtcgccttcaacgcgggttacctgctcgaaggcggcgcgaagctgtacggcttcggcacgtatgcgcaccggagcggcggcagctaccagaatttccggttgccgtcggtcctgcccgcgctctatccgaacggcttcacgccgcaggaaacgatcaacgaaaacgacttttcgctgaccgcgggcgtgaaaggcgaccggctgctcggctgggcatgggacatcagttcgacctacggccgagacaacatcggcatcggcatggtcaattcggcgaatacgagcctgttcgccgcgaccggatcgacgccgaccggcttccgcctgtcgaccttcacgaacacgcagtggaccaacaacctggacctgtcgcgtgcattccacctgccgctgctgcccgcgccgctcaacgtgtcggtcggcgccgagcatcgccacgaaagctacacggtcggcgcgggcgatcccgcgtcgacctacggtgcgggcagccaggcgttgccgggcctgtcgccgctcagtgcgctgtcgaaatcgcgcgaggtgctcggcacctacatcgatctcgccacccggctcgcgccgaactggcaggtggatctcgcggggcgcttcgagcattacaacgacgtcggcagcacgaccaacggcaaggtctcgacgcgctacgacatcacgccgcgcatcgcggtccgcggaagcgtcggcaccggctttcgcgcgccgtcgctcgcgcaacagtacttcacgaacctgaacatctcgccgctttccgcctacgggcaactggccccgaactcgcaggccgcacgcaacctcggcgcgacgccgctcaagcccgagaagtcgaccaacttcgatatcgggctcgtgctcaacccgctgccgaacctgaacgtgacgatcgacgcgtaccagatcaacatccgcgaccggatcgtgcagggcggcacctatagcggacaagccgcgatcgatgcgctgacgcaggccggcatcacgttgccggcgggcttgccgtcggtgacggcgaactatttcacgaacggcgtgaatacgcgcacgcgcggcctcgacatcctggccacgtatcacagcaacttcgcgaggtggggagcgtcgactgggatctcggcatcaacttcaacacgacgagcgtgacgagcgtgggccgcgacaccaacggcaacacgctgttgaacgcgcagcaggtcggctacatcacgtcgtcgacgccgaagaacaagatcatcgtcggcggcacctggcaccgtgacaaatgggcgctcagcctgcacgaaacgcgttacggcacgacctccggcgaagagagctactggagcggcccgaatgcattttcgacgacgcgtttcgcgcatttcacgaacgcggcgcgctacgtcaccgacgtcgagctgcgctatgcgatgacgcgcaagttcgaaatcgcggtgggcgcgaacaacctgttcaacgtgtacccgagcaagctgccgtccgagaaccagttcctgggcacgcagtacgacatcgtgtcgtcgccgatcggcatcaacggcggcttctattacctgcgcgcccgctacctgctctgatgcgcgtggctcccttatttctttcacttcttcattccatcacgccatgaaccgaccggcagaggttgaccatgcagtgatcgacgtcgacgaaacgtcgctgtgcgccgatcacattctcgatttgtgcagaggcaatgcgctcgcgatacgcattcgtgcgttcacgccgccggcggtcgtccggcgagcggaggagcagctgttcgcccatcccgaccggggcgcgctgggtcacgcagccgaattcacgcggctcggcatcgcgtacgcggaagtgcgatccgaagaggtgcgacaggcgtatcaccggcatgcgcgcgccaacatcgagcgcgttcgtacgttgttcggcgagctggcgtcgccggtcgaccggttccgcacgctgctcgacgacgcgtggcccgaagggcacggctgctgagtgtggacgggagcaagtgcttcgtcggcgtgtgccgctacctgacgcccggcgtggatctcgagccgcacatcgacaacctggaatggacgctgccggcgggcaccggatgggcgctgcagtatcagctgtcggccaacatctatctgcaggtgccgccgcacggcggcgagctggaactctggcgcgtcgcacccgatgcgcgcgaatacgaagcgctcaagggcgatcgccactacgggatcggccgcgagcaggtgggtgcgcccgacctggtgatcaagccggaggtgggcgacctgatcttcctgaatccgcgtttcatccacgcggttcgccctgtccggggcgccgaccgggtcacgttgagtgccttcgtcggcatcaaatccgttaccgaacccttagtttactggagctgaccatgtacaaggtttcattgcaggcacaaggaaaatttcaggcgcacgagtacgtcggcaagacggcactgctgctgatcagcgtcggcaaggaatatcacgaaggcgaaaagctggcggcgaccgtcgacaagatcaacgtggcggggttcgggcaatgcgtgattggcgtggccgatacgctgcagcgccacaactatgcgaccggctccgcgcgcagcaactatcagaaaagccgcgaccgcggcgacgcgtggctgcgggatcacgagggaaccctcgcgaaactgtcgatgcggcgcgagatcctgcgatgggatgacctgctgcgccgcgacgactattcgcagtactaccatctgatcacgaacgagtactactcgaatcccgaataccgttacgcgatcaacgacaccatcggcgtgttcgcggagcgcaacgggctcgtgcagggcacccgcgaacacgaggacgcattctatcgctcgctcttctacattctcgaggaatgcccgatcatcatgccgatgtgggcgcgggacggtatcgatttcatcatctacccgaagcagatgaccgccgcgatgagcaagacccgcgagattttcgtgcagaacgggagcgatgcccgcgccaactggctggcggtcaagttcaagaaaaatcgcagtcgcacgcagacgaggaaaccgaggcactggcgcatgactaattcatcgagcaaggttcggaaatacgtcgggctgaccggcatctgtatcgcgagcttcctgggatgtatcgatctcacggtcgtcaacacgattcttccggcgatcggccgcgacttttcgatcccgatccagacgacgcagtggatcacgtccatcttcatggtcgcgctgtccgcgttcatggtgccggttgcgacgctggccgacaacctgggccgcaagaagctgctgatcgtcggcctcgtgatcttcggcgcggcttcgttgctggccggtatcgcgcatcagttctggctgctggtcgggttccgcttcctgcagggcatcggctgcgcgatcctgtatacggtatcgggcgcgatcgtcagctacacgttcgacgagagcgaacagggcaaggcgctggggatcctgttcggcgccaacggcgtcgggctggcgctcggcccgatcatcggcggcctgttcgccggcgcgctcgactggcacgacgcgttcctgatcaacattccgttcatcgcgatcagcctggcgctctgcgcctgggcgataccggagttcaaggcgcaggcgcgcaagcgcatcgacgtgacggggtgcctgctgctggtcgtcggcctgaccacgctcgtcagctatctgtccgtcgacggcggccggctcaatctctggttgctgccggtgtcgctcgttgcgctggcactgttcgtctggcatgagttgcgcacgcgcgacccgatcgtcgagtttcatttcttccgcgaaccgaggttcctgtccgcgctgctcgcgacgttctttctcgcgttcttctactgcatcgtgctgctcaccctgccgatcttcttttcgacccagctccacaagagcgacatcaccatcgggctgtatctgctgccggcgaccatcacgttctccatcgcgtcgtcctggatcggcggccgcagcgaacggctcggcccgtcgcgggtgatcgtgaccggcctgtcgctgttcgtcgtcgcgtcgattctgctgtcgatcgtcgcggggcagcccgacgcagcctggttcgtcgtgccgctgctgctgttcggcatcggctggggcgcgatactcgggccctcgacgctggtggcactgggtgcgctgccgcgcgaaaaggcggccgtggcgatgggcacgtcgtggaccgtgcacaacgtgggcggcgcgagcggcattgcgttcgccatcttcctgatgcggcaggtcgacgatttccggcatggctaccagacgctgatgctggcactcgcggccatcatcccgccgccggcgcgctgtaccacgtgctgtcgcgtgagtcggtagcggtggccatcgactgatcggccgccggatacgcatcgctcgcggatcgtcgcgcgaacgggctcccatcaatagcaggcggatgtccgggcggttgcctggcatccgtcgtcttgcccgacaggcgctcggcctggctcgcgcggggcgcgctcgcgcatgcgtgctttccaggcagcgtcgacacgacgccgcgggcgattcccgtgcggcgtccatgcgatccgggctgacgtgaaatcgggcacggcgcccgaaacgtggcagacacctcgtcgagccggaacgatctgcatttcgaacatgaattcggatctctaaacagatgccgtttcaagaatacgcgcggccaggccggcgattgtgggcgggaaaaagatgaagcaaagcgtggtgaggggattgccgcagcgtggttctgcgcgtccacggcggtaccgggagcgtccgcatgggcgcagtcgcagtcggcatccggcgcgacgacgtcgacagtggccgtgcctgcggcgccggcgttgccggcatcgggcgcgcacgaggcgctgacggtcaagcgtttcgaagtgacggggtcgttgatccgcagcgcggacaaggtcggcttcaaccaggtccagacgatcacggcgaaggatatcgtgaacagcggccatacgacggtcgcggactatctgcgcagcgtgacggccaattcatcgagcagctgggggacggctcgaccgcgacggccaacttcgcggtcggcggatcggggatcgcgttgcgcgggctgagcgaaaaatacacgctggtactcatcgatggccagcgcgccgccccgtatgcgtacgcggccaacggcaccgatcagttcttcgacctgaacacgctgccgctcaacatcatcgaccggatcgagatcgtcaagacgggcgcggtgtcgcagtacggctccgatgccgtcgccggtgtcgtgaacatcatcacgaagaagaactatcggggcctggagctgaccggcagctacggcggcgcgacgaacggcggcggcggcgcgggcacgacccggttcggcttgctgggcggcttcggcgacatcaacgcggatcgcttcaacgtgacggcggcgctcagctactacaagaacaacggcgtgctcgcttccgaccggaacatgacggagaaccagaatttctcgaactatcccggcggcctgtccaaccagtcgacgtcgtactgggcgagagcgaacggcaacgtgccgctcgacccctgtgcgtatggcggcaaggtcgtacccggcaacacgaattcccaatcgttcggcgcaggcggcacgatctgccagcgcaacacggcaggcgcgtcgtcgctctcgccgtggaccgagcgcctgagcgcgaagctgcatggcgagttcaggatcgacgacgcgatgcaggcgttcgccgatctgtgggagagcaacaacacgacggtcgcgaaccggggcgtcggccgcctgacgaccagtacgcagacctacgacccggcgacgggcagcgtcgcgctggtatcgaacgtcgtgccggccggtaatccctacaatccgttcggcatgccgacgcagttgcgctatgcgtttccggcgtcgcagtcggtgcatgtcagttcgaactactggcgcgccgcgacgggcgtgaagggaacgttcgcggtgccgtccgcaggcgactgggactggagcgcgtcgtatgcgcattcgcaggacacggtctcgcagaactattcgaaccagatgagcgccagcgcgctgacgaacatcatccggaacggcacgttcgatttctccaacccgtccgcgacgccgaacggactgaacggcctttaccagagcacgtcgaaccaggcgatcacgaagctcgacgtgctggatgcgacgctgtcgagtccgaacctgttcaggctgccgacgggcaacgtgggcctcggactcggcgcgcagttcatgcatcagagccagtacatcggtacgggagcgggctgggcgagcggccagctgacgtcgccgtcgatccagtccgtcgacggcgagcgcaatgtcgcggccgtctactatcagctcgacattccgctgctgaagacactgacgttcagccagtcgggccgctacgatcactacagcgacttcggcggcgcgttttcgccgcggttcgcgctgcgttttcagccggtgcgggaactcacgttgtacggttcgtacaatcgcggcttccgtgcgccgacgctgatcgagaacacgtcgtcgcggacgttcggctcgcagggcgtggtggacgcgcgagatccgaacaatccgggttcgtacaacatcgtcgaggaaattcgcgcgggcaatcgcggcctgcagcccgagcgcacgaagaactataacgtcggcttccagttttcgccgacacgtacgaccgatatcggtttcgactggtacaagattcacatcgacaacgtgatcggcacggacgacgtgcaggtcgtgatcaatcagaacgatccgtctcaggtggttcgcaatgccaacggcagcatcgcctatgtcacgcttccgtatcgcaatctgtcgtcgctggacaccgacggtttcgaggccacgttccgccagacggtcgcgacgaaaatcggtaccttcacgttgtccggcgattgggcgtacatgtggcacttcaagatgccggttggcggcgtggaaagagattacgccggcaacaacggcgcacttcaccagccgttcggcggcagttccccgcgctggaaagggaacaccgacctgagctggaaccatcaccagtggaacgcgaccctgagctggctctatgtcggcccttacgcgcaggccattctcgcgccgggcacgtaccccggcatggcggatggcgttgcgtcgtacagccagttcaacctgatgatcggctacacgggattcaagcactggacgctgtacgcggggatcgacaacctcttcaatcgcaagccgccgttcgatccggtatggatggcggggccgaccggctacgattcgtcgctctatacgtatgtcgggcgattcgcgcaggtgggggcgacgtaccggttctgagggccgtcgccttcgccgttgaatggcaaccgctgagggtcacgcgccgcgcggcggcttgctgctgccggtcatgctgccgagctgctttcgatcaacccggcggcgcgacggatgcgccggtgatgccatgccgtcgcagcgcatccgcgacgaagcccgacgccttcatttcctcgacgaacgcattcagcgccgccgcggcggattcgccgcgactcttcggcacgcccattgcctgccggatcaccatgaaccgttcatcgagcaggcgcaggccgggcgttttcgccgcgtcggcctcgagctgctgcttcacgcccgccgcgacttccagctgctggtcgacgaaggtctgcacgacggcttgcgacgacggtgcacgcacgatctgcgcggccttcagctcgcgtgtgaggaacaggtcgtacgcgctgcccttgccgacggtcacgcggttgtgcggctggtcgacgtccgcgttcgtgcggatcggcgacgcgtcgcgcacgagatagaaccctcgatcagcacgtacggcgccgtgaacgcgaccgtttcgccgcgcagcgggtcgaccgcgaagaaaccgaaatcggcacgctcgtcggtcagcgcctgcaccgatttggccgcggtgtcgaacaccacgagttccagctcggccgacaggcgttcggcgaacgcgcgcgaggtcgatcgacacgccgaacggttcgccggtttccgggtcgcggttcgcgaggatcgggttgccgagattgatcgacgcgcgcagcttgccggttggcgtgaacgcggagaggacggagggggcgagaggcatgggtggctcgttgcggtcgtagggtcagggttccgggcgtgtcgatgcgagtcgaagcacgacagtgcgccggcatcgagcttatcacccggctttcgtgacggggcagcatcgagcgattcaacggcctcgcatggtctacgtcgatcgcggccacgattccgagcggcatcggcgagtcctgcgcaatcgcggtatccggccggtgatcgcgaagcgccggaccggacacggcagcggactcggcaagtatcgttggatggtcgaacgctccacagttttcgtcgcctacgcacttgcttcgagcgacggactgacattcacgaagcattcttgaaactcggttgctcgcttgtctgttggaatatcttcaggcgtatcgagcagccttttgaactggcctccaagttgagaatattcagttcagctgccctggcaaagtggcgcgggaaagcgaaccatgttggtcgcgcagtttcattaagtaaatcgagcataacgggcatgccggctgttgggcttcgcagtcgatttcgtgtgcagataaacagggcacgcataatcggatttcgcgatcaaagattgaacaatgaccggccgtctctggccggcaatgcgctgtttcgtgctctcgattatctatcgcttgtatcgtggccgttcgatgggacggcgtcttttgatacggcaggatttcgagttgcaggatggttgtacgagcggcggcgtaaagaaagcagttcaacccaacgacttatgcgaaaggcccaaggctgcgcggcgtcccaactctcctatttgcctacccgtccgagtcacatatatcgatcacgtgacgagcctcgaacttgacttcaaagtcggtaaccatgtcgcgagtacacaatgggtcgttatcgaaccgaccaacatacacccctcccacgattccttctgtaattacccgcatgcgttcttttcgtttcgctcccgatccactgtccggatacgaaagatgagcttcatgatgtcgcccggaacgagggactcgcgtcgctgacgctcgggtaaccagaaggcggcggggtgcgccaaagcgatcggctcggcatcatccagttcccacccgtcccgatcaatctctgcaagcgacatcgttttctccggggtttttcgagggctcttggcatggcctgcgattcttttcttcgcagcggctcacagttcaggacagtgcggcgtggcaggcgcgttgcgcccgtacgagataggtgcgcacgacggccggatcgagcccgagcgagcgtgccgcctgttcgatgctgaacccgcgcacgcgacacagaaagtatgcctcgcggcaaacggccggaaggccatccagcgtttgtgccagctgggccaattgacgacggcggtgggcgtcgggacgcatcggctggggccgggcaggacgggcgatccagaaccatttgctattgctgccgcaagtgagctatccggttcagggagccaaacgcaaagaagcgcgtcacacgcatcttatcccttcgtcgggaaaaacgaaagtcacgataacgattctcaacattcttctagccggcgacgcaccagttcccatgcgtgtggcgcgagccggaagccgtggccgtcccggacgattaaacctaatcgaacggccctctggatccgcgcgtgcatgcgattcaactctgctggatgatgcaggtgagcggcacattgtccgatcgtaaaccgtccgtcctgaaattcgcgatccaatgacatcgagaagcgcatgcggaacgaggtcgaggtgatcgtgcatcgattcacctggtttgacgaacagtgttccgggtgcacggcgttgcatccctgtgatggtcgaagtgcgccatggtgtttgcaaactcgcgagaaagaaccgtcggcgcaaggagccgatggctgaatcgagttgcgggccgggggtagacaacgactcgccgaacctcagcgatgacccttggcaatagctgacgtcacgatactaagcggggcaaacaggaagaaacaagatcgaatcggaaccgtgaatttgttaactgatttggaaaattatccttgtcgacgagattaatattatcaacctccaaagcaaagggtatcgataatgaattgaaatgtgaaaaatcgtaaaatcacaatagagcgatcgtttgcaattatgatggcgaagcgttagggttatggcgctgcagttcccagacgtttgtttatgcagctgtatgtgagtgcggtgcgaccaatcgtagtacgggcgatcattacgacgcgccacatcgagacacgaaaattcactatccggtcgtgagaacggagcgatgatgatgcgccgcgactagacacgcgcgagcaagcgttgtcgcattttcgaagaaaaactctaaaacgaacctgagagaacaatggtacttagaccatccgcgccggggagtttaaatatcgcgagctttataacgcgatccatcggggcttattgcagaacaaccggctgttgcgactggacacgccgctcggccaaaacgcgctgatccgctgcgcgcgcgtggttcggcgcggattggccgcgactaccattggacgatcgatgtcgcgtccctgcgcgacgatacggcgctgctctcgctgatgcatcagccagtgacgctttggttgcaacagcccggtgcccctttcgccgacgcggtctatcggccgatccacggctttgtacacaaagtcggctacctcggcggggacggtgggctgtcgacgtaccagctcgagttttcctcggcgctggtattcctgggcggcacccacaacgacgaaggctggaccgaacaaagtgcgcaggaaatcgtttccgagatcctgaatcgctatccgcagctgcatggcaacttccgcttcgacctgaatcgcgaaccggcagtgcgctcgtggtgccgccagagtgagacggatctgcactttttccatcggctgctcgaagacgagggctggtattgctactgggtccacgatccggtccgtaacggcgagacgcccaagaccacactggtgatcgtcgaccgggttgccgcggtgccggatccgaaggcagccgattttgttcgcgatgccggggacggtgaagtagtgagcgggtttgcgcattgggcggccatgcagacgatgcagagcttgcgatacgaatcgagctcgttcgactacaagcgcccgaccgctcgctttgaagtggccagtgcgctccagtcggtcggctacgcggccgacgacggtcgccatcaggcggagcaacaatcgataccggctgcaccgatgacggtctatgagccgaccgcttacggctatcccgatgagagcagtggcgaagcgcgtgcacgcaggcgtgtacagggctgggatgcgcgagcgcgccgatacttcggggtcggagggttgcgttggctcgatgcgggatcgcgcttcgtcctgaacgaccatccacgccattcggaacacgacagcgatgcccggacctttctggtggtcgaagcgcgctggttcatcgagaacaatgtgccgatcggccagccgttggcggaatttccgctgagtctgcgcgcgacactggatgaacaacaggcagcccacggcgcacgcttctcgactccgggtcatggcgaggacggcacaaccggcttttacgtgattgaggtcgaagcgcaggacgcgcgcctggagtatcgcagccctttcgagcatccgaagcccgcgatgccgatcgagcatgcgctggtggtcacgcaggaaggattcgaagcgtggtcaaacgaacgcaatcaggtccgtgtccatttcgcatgggacaggaagaatccgccaggtgcgttcaatgcctcgcccctgctttcgtcgatgcaggcggataccgggaacggctacggcggggtgcatgttccccgcgcgggcgaatgggtgctcatcggctactggggaaacgactgtgacaagcccttcatcttgggccgcgccagcggtggcacgacacccgcgccctggcacaccaatgtgctgctgtcggggtttcagtcgcagggcttcggcaaaaccggagcgtataacgcattcatccacgacgacgccacgaaccagggcggcacgcgactgatcagctacacggggcagagctatgcagcgctgacccagggttacctgatccagcaggacggcaatacgcgtggccgctatctggggcaggggttcgtgctgcacgccgacgaatacggcgcggttcgtgcgagcaagggactgtcgatcagcacgcatcggaaagcctacgacgacgaacagatgagtgtcggagaagcccgtgcgcaattgcagaaagccgggatgctggcggaatcgctgtcgagcgccagcacgacagcacaagccgaatcgttgcaagccggtcaggacgcgctcaaggcgctggccaaggacgcggagcaggcggtgtcgggccaaaattcgggcggggtcactgccggcggcggtaccggcaacgccaacggattcgcgaaaccggtgatcgtcatcgcgacacccgcggacttcgccgctatcgccgatcattcggcccacgtggtggccgagaaggaagtcaacgtgatcagtggcgagaacacgcatctgggaagcgggaagtcactgatcgttgcggccgcagaaaagattagcctgttcgttcacaaggccggcatgaagctgtttgctgcgaaagggaaggtcgagatctcggcccacaccgacgacgtgcgcgtgaacgccgggaaagaagtgaacgtgaaagccaagcgcatcgtgctcgatgccgacgagatctggatcaaggccggcggatcgtacacgcagtggtcggcgtccgggatcgaggacggcacgcaagccggccgcacgatcaagtcggcgtccttcagtcggcaggggccgagctcggtggcccagcgaatgaacagcatgccaacggccaagttcaacgacccgtacgtactgcgtgatcgcatcaccggcgaggtgctgaaaaaccatccgtacgagctgattcgtggcgacgggacaaagttgtccgggacgacggacgagctggggcagatcaccgagcagaagagcgaggatatcgagaagctggcggtacgcgcattacggcgccggccgagcggtcctgctgagtgaattcgacaaccgacacgcgaaatagaacaacgacgatgactgacaacacgaacgattccgccggcggttcgccgttcagcgatagtgcagaacaggatgtcgtgcgggtgaccagccgcacggacaaggacggcgcgtcggtcgggcatttcacgttgacgccggcgagcgatacgcggcaaaaggagttgctgtgcgacgtccgtccgatcatgccggtgatcttcctgccgggcgtgatgggctcccattggtcaacaaggagaccggggacccgatcttttcccaccgaacacggacggcatgttgggtgactttggggcactgccggcgctgctcggcatgtggttcaagggcgcatccacgcgagagacgcgatacgacccgaccaaggcagtcgtgacaccgctcggacctgttcgtgcgggcaaggtccagaaggacgatagcgaagaccagtatgtcgacgaagccgaggcactccgacgtggctggggctcggtctaccggtcgagctaccagccgatgctggcttggctcgaggagcagctcaacgagccccgatgcatggggaagaacaaaggcgcgtggatcgagaccgatccggacggcaaggactggacgctcaagcccttgttgggcaccgagcccaccgactatggtgcgacaggtgtgggtgagcaaggccggggacaggcgatcaccgaagactcggaagtcttcaaacgattcttgaagtaccgctaccgggtctatgcgatcggctacaactggctgcagtcgaatgaacagtcggcgaaggacgtgatcgaaggattgacgttcacggacaagaagagcggcaagaaagcgcggctgatggggatcaacgagatcatcgccgagaacgacagcggcaaggcgatcattctcacccactcgatgggcggccttgttgcccgtatggcagttgcgatgcacggtgcagagggtttgatgcacggcgtattccacaacgtgctgccggcgaccggcgcaccgatcgcggcaaaacgatttcgcacgggtggcggcaatgaggggttgctgaacgggttcatcaacggcgcgctgctcggcagcaacgcggacgaatttgttgcagtggcggcgaacgcgcctggcccgctggaactgctgccgatgccggactaccacaacggaaaggcgtggtggatattctcgcagctgaacggtaccccggtaatgacgttgcccaagaatggtgacgcctataacgacatctttacaaatccaaactggtacgggttggttccaaggcagtctactgggctacttgatccagcaggcatcataaagagcggcttggcgcagacgccaaagataacgacgtcttcgaaaattttacggcgacaatgttttccgtcgtgaacaatcagctagaaatcaaggattcgtatcaccgaaagacgtatctctcatatggggacggcgccctggtagcaaaggggcggtggactcgagcgaggacggagataaaagcaagacggagaaaagcaaaaactagatgacttgctggcgtggggtactgtgatctggaagggtaatgtgccgccgggtgtgacagaagaggagttgaaatccgcccgatttttgagcgactcgcaccgagggacggtacgcgtgcatctggacactcgcaacgttaccatcgagtttgaggtacagaaaaacctgtattgccggacggaagcaaagtcccggatccggaaaagaacggtatcgtgccgggagacggaactgtgccggtttggtctgctgaatcgcctgcaaatagtgcaaatggcggagcggctaagggtgtacaaatgatattcgatcaaggggctatgtgcaccaggaaagctacaaccatccgtgggcacgttgggcgttactttatagtattgtccagattgcgcaggacgcaccggagccgaagaattgaaccgaattcgccatcttgtacttctggtagcaggcctctcggtctgctcattgaccttgcgaatgaactcatcatgacgaatcctttattgtccaagtcgcgaccctggtgcatcgggcgcttcgtgttcgaccgaccaatttccagcgagttgacaaatcaagagtataaatttcgcggagacaaactggagacacaacacaacgcgtcgatgatcagttatcaagccaagatcgacgcgttggaaaaagagtatcgaacgaaaagagattcgatccgtcagatccgaataacaagatggggcatgcttggctcgaaaaagcgttctctccaaaaaagattcgatggtgttcgtctaccaaaagggcgtggcaaaggtagcaaaattaccgttcgatacggaaggatacatctacgagaattcaacgttgtttcatacggtaggtcgaattggttcagctgcgattggacgtgccgaagatatttataacgacacgtatcggcgaatcaaagcgcgggaaaactggacggttccgaccgaatcgggattttgctttgacggaggactggtcacgggggcatcgacctatagcgaagaagtaacacaatcgcttgccttgctgcctggaaggcctgcgctacttgtcatcgaaatgcgagattctgtcagttcggatcaggggcgcccgctaaccaagacgcttccggacctacgcgcgaagatggaccagatatcgagcgggagctaccggatcttgcgacaagggaagcgcacagtggccggtatggacgccgaggaagtgctgttcgcgttgaaggaaggcgaagttacatcttatcggttctatctgcttgcgccgggcgatccgagcaccttggcgaagccgcatacggccattcaattgctgctcggcgcgagcagcccgaacttgtcgcctgaagaggcgacctcgccggtcgacgaggcgggcgcgctgcaaacctgggagacgttgttgaacagtctgcacctgcggccgggcgcggtctaaacggggccgccatgcgacgcttcgacatcctgaaaggcgacgcgacgacagtgggcggcatcgtccagggcggcgaccatacggatatgatcggcggccgagaacaagcctacgagcacgatccggtctggtgtcccgtctgcaagacggtcggaaagatttcaaccgatggcccgcggatttccacgaccggaccggatggtcggcaggcagcgttaagcgacgatctatgcgtgtgcgcgtgcccgacgccgccgaaactcgtggcgtcgcaatcgacgtcgtacatcgacgtgtagaacagggaaacgggatctcgacggggtacgctggccagctcggacaatctctcgggattgcgactcgcgttccggccaccagggctgcggttgtccacgatcgaccagcagcgcgtcgagacccttgccttcgatccacttcggcttggggccgtagccggaccacgatttgcccgacttcgggtcgcaatactttgccggcgccctgtgctttttcttctggctgccgatgtagcccaacgcgctgaggatttttgctgcgtaattcccagttgctttacctgttcctagaggttcgaaagcacgcttttcttttccgaacgccggccccacagcgctcatcgctaccaacctccggccacggtccgtcgagcctggctggattccgataatatcgacgcgagactcactgcctgattggctacagaatcccgccgcaggtcaaggctggaatcgcttttgcgttgcgcccgtggtggcttccggtttgccgtgccgttccacgtcgcgggcgtccggccgggcgcggcgggccttgatcggtccggcaaccgctagaattgcggttttagcccggaatacgtccatgtcttttgcctcgctcggcctgatcgatcccttgctgcgtaacctgcaggacctcaattaccaggctcctacgccggtgcaggccaaggcgattcctgccgtgctcggcggcaaggacgtgatggccggggcccagaccggcaccggcaagacggcgggtttcgcgctgccgctgttgcagcggctggtgcagcacggcccggcggtgtccagcaaccgcgcgcgcgtcctggtgctggtgcccacgcgagaactggccgaacaggtgctgcaaagcttcatcgcttacggcaagggcctcgacctgcgattcctggccgcttacggcggcgtgagcatcaacccgcagatgatgaagttgcgcaagggcgtggatgtgctcgtggccacgccgggccggttgctggatctgaatcgccagaacgcggtgcagttcgatcaggttcaaacgctggtgctggacgaagccgaccgcatgctggatctcggcttcgcgcgcgaactgaacgccgtttttgccgcgttgcccgcccagcgccagacgttgctgttctcggccacgtttagcgacgagatccgcgcgatggcggcgagcattctgcgcggcccggtcaacatcagcgtcagcccgcccaacgccacggccagcaagatcaagcagtgggtggtgccggtggacaagcggaacaagcccgacctcttcatgcacctcgtggccgagaacaagtgggagcatgcgctggtgttcgtcaagacgcgcaacggcgtggtttacctggcggccatgctggacgaagccggttatgcggtcgacaccatccacggcgacaagccgcaacccgcgcgcttgcgcgcgctggagcgcttcaagacgggcgaagtccagatgctggtcgccaccgacgtggcggcgcgcgggctcgatatcgacgatctgccgctggtgatcaacgtcgatctgccgatcgtcgcgcaagactatgtgcaccggatcggccgtaccgggcgcgcgggcgccagcggcgtcgcggtgtccctggtgtgtgccgacgaagcgccgcaactggccgcgatcgaagcgctgatccggcaaacgctgcgccgtgaagaagagccgggtttcgaggccgaacaccgcgtgccggaaaccagcgcgacgggtcagatcatcaagaaacccaaaaagccgaagaagccgaaagtgcagcaagcggtgcccgctgccagacaggtgcccggtaaaagccgcgcccgcaagcgcaaggtggagaaagcaggcacaagcctgcggcggcgcacgcaaagccggccggtaacgaaccggattacacgatcggcagcccgttcagcgtgcagaaaccgcgcggcaaatcggcgggcaagccggctgcgggatcgcgcaagccgggcggcaaacccgccggtggccgtggcaagcggcagccttgacgtgtcgggacgagtcacgccggtcgttgaatatggctggcggcccgccgccagcttcaaggaggttgcatcgacgggatgaatccggcgtaacgccaggccattcgcgtcggcgatctggcaatatgcatcgacggacttcggacacgggcaccccatgcacatcgccattctgacctttcagggcttcaacgaactcgattccctcatcgcactgggcgtgctcaatcgcatcaagaagcccgactggcgggtcacgctttcatgtccggagcatttcgtcacatcgatgaacggggtgaccgtacaggcgcagtcgacattggccgacgcatgcacggcggatgccgtcatcgtcgggagcggcattcgaacccgggatgtcgtcaacgacgcaacgctgatggagcagttgaaactcgatcccgcccggcaactgatcggtgcccagtgttcgggcacgctggttctggccaagctcggcttcctcgacaacgtcccggcctgtacggacctcacgaccaaaccgtgggtactcgaggcgggcgtcgaagtcctcaatcagccgttcttcgctcgaggtaacgtcgcaacggcaggcggctgttttgcttcgcaatacctggccgcatggatcatcgcgcgcctcgagggcgaggaagccgcacgcagcgcacttcattacgttgcgccggtcggggagaaggatgagtacgtttcccgtgcgctgacgaacatcacgccttatctgccgtaatgcgataagaatcgcactgcgctcatcgcggcgagccggcttgagcggtcatgcggtgttcgcgatggcggcttcttcggcgccctccgtgactttcgttttcccttgcttgcggatgtcggataccaccgaatcgggaagcgtgatggggtcccgatccgcgaggttcaatgcacgtcatttgcgacgatggacgccaacgctcgagcgccgtcgtgctgggccgtgtcttcagtggaaaagatgtggtggctgaatgcgatcagtttgaagcctgaccccgtgggacgagggacggtgataccccagtgccagccaccgtcctgctggaacacgtggagggcaggggtgcctgattcagtgctgatgaaaaagtcgtcatggcgtgctctcccgtcatggggcgactgcagggcaactacatcggatgcgcgaacccagtctacgggcacttttgctgcagcgcaatatccggatgacgcgaacatgccgatgtgcggcgcgccataattttgaaatacaaatatgcagcgccggagatggctggcatattgatgtgacgattaagaatgttcggaggcttcatggaccgcagttcgcttgtgtgggcgggggtaccgcatagcagcgatggcgtcgtgtttcaggctcgggtcggccgcgggcttcagcgctttcatgtttcccggtcgattctcgagaaggcatgcgacctcgagcgactggcatccgatgcgcgacagctcgaatgcttttacgagcatctggcctcgatcctggcagtcgcccggaagacgcgctcgaatgcgaaagccgatacggtttcgctgaaggtttccgattttgcccgaacgggcagcgtgcgtgccgggcaggatgcccgggcggggatgcgatgagtatcgcggaggcctcagatgttgtccgcgcgccaacgacgcggtgacacgccggtgacgcgcgtaaatgttctggtgaagtggctctgatccgcgaagccgcagatatccgagatcatgtgcagcggcatggatgacgtgcgcatgtacatgattgcgcgctcgatgcgctgattgatcagccagcgatggggcggcaacccggtcgtctgatgaaaggctttgacaaagtagccgcgagacaggccgcacgcttttgcgacatcggcaatcgagatgttcccggtcaggtgctcgagaagaaatcctttcgccattcgctcctgccacgccgtgagcttgcccgtcgacttctcccgccgctcgctcacgccgccgtactggcgcgcgacatgcgcctgaaaggcgagcgcgacgtggtcgacgaagagccgggaggcatgcccgggctgcgccaaagcggggagcagggcctggcccaggcgatgaatgatcgggtccaccttgctcaaatgcggcggcaggtaaagctgtggccgctgcctgccccgagttcatcgactgtctcctccagcgttcggcggggaggtgaaaatggatgcagtcgaacgttcccttcaggtcggaaacccatctgcgatcgaggtcatggatcgtgacggttcctgcttgataggggacgaaacgagcgacacgtccgtcaagccacaattcctgttcgccgaacgcgcgcaattgcaacacgacgagatcggcgtcttcaagttcgtatggcgcggttcggccaatatccctgcgggatgtcttcagccgactgatgctgacctgtgagtgcggcaacgtctgcgtgacgacgctttgcctgaggtcggccggcatgaaatcagatgatgcgttgtccgactgtgcggcagtcataagtccgcgggaacgtgaagaatggggcggcgaagtatatcaaagcaaaatttggctggcgtgcgtcgtgtgtcgccgatgtagtggcagagcgtgaatacggcgtgacgtgggccgcgctcctgtcccggccgggtcgatgtcggcgattggacatacggacaatcgatcagcgcgtaaaggacgttttccctcgtttcaggcggaatgtcgttatttgagggttccggataaaatgcgactttccgggttttcagttaacgacttcgtcatgcatcgaatcggattcttcgtttgccgtggctacgatgtgctcgatctgggtgggccgctgtcggccttcaatcaggtggccaccgtggcgggccacacgccgtacgacctccaggtcatctcgcagtccggcggcccggttcccggcaatacgggcgtttcgatcgaaacgcggccgatcggacggcgcacgttcgacaccgtcattttcgtgggcggggagatcgagccgatgcgggctccggagaacatcgccgctgccaggaaactcggcgcccgggcctcgcgggtggcaagcgtgtgtacgggggcgtttctgctggcggaaaccggcttgctggacggcgtgagagccacgacgcactggctgtacgcggctcagttgcagtcgcgcttcccgcgcacccgggtcgaaggcgacagtatctatatcgaggagggccgcatctggacgtcggcgggcatcgcctccggaatcgacctggcgctcggcatgattgaacgggatatgggggcggagattgcgcgtgctgtctccaggtatctggtcgttccgtatcgccgaccgggcggccagtcccaattctcggcgatgtcgcagatggagccggaatcggaccggatccgcatcgcgctgaattttgcccgggagcacctggccgaagcgttgccagtcgaacggctcgccgatgcagcacgattgagtgtgcggcagttcggacgcgcatttcgccgggaaaccggtgaaacacctgcgaaggcggtcgagcgcctgcgagtcgaggcggcgcggctgcgcctgcagagtggtagcgaaccgatcgaacagattgcgctggcggtggggttcaccgatccggagcggatgcgcagggccttcatcaaactgcatgggcacccgccgcaagcgattcgacgcgagagccgatcgaacggcgcgcgctgatcggctgccggccgatcagcgcactgcccatgaatgtccgtctaacggattagtcgtgctgcgggcaggtcatgatccgtttcgccggatgctcattggttattcgtcggcagcggaccgtaatcgttccacatgtcgcgatgcagcttccaagcgccgccttgcttcagaaagacgagcgtctgcttgccgcggtatttgagctttccgtcgtggtcatggatctccgtatccgaaacctcggtcacgacccggtcgttgccgtagaactcgtagttgctgaacgatacggtgacaggcttcgatccgccataccctttggtgaggtattcggtgatcgcgcggcccccgttaccttgtcgccgccgggcggcaagagggtgccgtcgcgggtatagaggtgaccgattgcttcgtagtctcctcgcgcgaaggcatccgcccatcgtgcattctcggctttgatggccgcttcgggcggatgttgcgaaccaccggcagatgccggcgtcgcaaacgcgaaaaaggtgacgcaggctgctgcaagtgcggtagcgaaagtacgattctgttgcatcgggtattttccggttatagctcgaattgagaggactgcgaaaatttaaagggcaggcaggcaatgtcggagccggtgatcatcgaggcctgcagacggcccgcgcgcattgccggcccatgtttcatcgaacgccaggaatgcgtgcgagcccctggaggcgccgggcagttccttgtcgaccatcgcgacgacttccggccgcgcgtccctcggatggccggagtggaacggcggcgcgggatcgtattcgatcacgagttgcgtgaattcggccgcctgtcggccgcgcagcttctccgccacgcgaagcgcgaagtcgatgcccgccgtcacgccgccgccgctcatgaaccggccgttgtcgtcttccacgaagcggtcgggaacgggaatcgcgccatattcggccagcttgttgacgaaggcccaatggcacgcgcttcgcttgcccttgagcacgcccgttgcagcgagcacgagcgatccgttgcagaccgacgtaacgtgcctggcgctttccgccaggcgccgaatctgcgcctggtacgcgggtcgcatcggcgccgtcaaatcggacccgccggggaccagaatcacgtccgtcttgtcgatgtcggccagccgctcggtcttgccgtacacgacgccgaattcgagcgtcacgttgccgccatcgaggctcgcgtagcgaacgttcgtattcggcagccgatggaagatctcgctggggccggcgaagtcgagcagcgtcccgccgtcgtaattgacgatcaggatgttgagcggttcattcggagcaagttcgcccttgctgccggcctgcacaagagcaggggtggtgtgcgcgagcaacgcgctgccgcccaggatggcgccgagggtggcggcgcccccagcttgagggcatcgcggcgcgaacggcccgctctcgtgagcggtgttccggaagcattgtcttcgctacggtcggtcaagatcgtttctccttgcacttcggcccctctgcgagcgcaaccagattgggccggattgaatggccgccgcgacgaacggcgtggcggacgtgagatcgggatggggatgagcccgcatgatttgcagggctcaggcatcgcgcgccgcaggcttaaagctgcgacgcgccgccatcgacgaccagttcggtgccgacgacatacgacgattcgtcgctggcgagatagagcgccgcgtacgcgatgtccgtggcgttgcccatgcggcccaccggaatggtttcggcgaattcggccttgcggtcgcgaacccattcgtcgggcatgccccatttggtgagcagcggagtgtcgatcacaccgggcgcgatcgcgttgaagcggatcttgcggtcgagaaactcgtaggaccagctgcgggcgagcgatcgtacggcggctttcgctgccgcggtcaacgagatgccatgcttgccggtctgcgcgacgaacgatgtattgagaatgaacgaggcgcctggccgcaggtccggcagcaccgcctgaagcgtgaacaccacgcccttgacgttgatgtccatgatctcgccatagagcgcgtcgtcgatgtcgttgaccgcggacgggaacgcccagcccgcgttcgcgaatacgacatccaggccgccgaacgtctccttgacctcggcggcaatcgcacgcatgtcgtcgagcgaacggacgtcgcccttgagaacgagcgcatgttcgccaagctcggccttcacgcgctcgaacaccgtctcatcgcggcccgtcaccgctacgcgggcgccttccgcaatgaacagcttcgcggttgcgaggccgatgccgctggtaccaccggtgattaacgctgacttgtctttaagcctcatcttctgctccatttttacgtcgtgattgatcgggccgaaggcttcaaacgcaattgcgtttgtgtgcctttccggctcgatcttccacgtgcagtatggaacgcgaggcgtatggcgcaaaggtcgtataaccctcaaaaagcgccactcggttcaaacgggggaataacgcggctcggcgtttggcgggggcaatgcccgttcgcacgcttcatgtgtggtctcgctggcggcgagtgacatgtgaagcaggcgtgcgcgaaggtcggacgcgcagcggtcgcgatgcggatgtccgcgcgatcgcaacgagtggccggtatctggatgccgtctgcttcattcatcgcgctcataacgcaaacggtatccccattcgttcgctcgatacgtgcgaacccgcgttcccagatgcatgccggcgatcaacagtccctccgaactgacctgatccagaagccgtgaccgcgtagcagcggccaacgacgcatcgtgatcgaaggcaatcgacacctccggccgctgaatctggatatgcgggaaatgaaccacgtctccccacacaagaagcccctgatcgcgggattcaagcacatatccggtgtgtccatcggtgtgccccggtatcggcagtgcgtcgatgccggggagcacttgcccgtcgtcgaaaagacgaagccggtcgccataagcatcgaacacccgacgcgccaccaggaaatttccgcgtgcgcgttcgctggcgcgactcagattcccgtcgtcctgccagaacccgacctcgcgtcgatgcacgaccagttccgcattcgggaacgcgatctctccggcaccgttcacgagcccccgacatgatcgggatgcgcgtgggtcagcaggatggtgtcgatcgcggcgggctcgataccggccagcgccaggttcgtcctgagttggccgccccattgcctgaacccgcccgccccggcatcgatgagcacggtgcggcccgcgccgcgtacgacgtagcaattgatgtgcacggcttctggctctttctgcccggcgtcacgttgcatgttcgacgcgtcggccggatcgatattcgacagaaagtcgagactcgcggtgaggtagccatcgctgatggcggtaatcgtgaaatccccgacttgctggccgggaaaggtaagcgtggccatcgtgcttctccggatcggcgaatggtgggctagttgcgggcgtgaatgttcgacgcggtgtaaccaaaacaccgaatgcgcgcggtgaggccggtgcgctgaacgatcgcacgatccagcgcttccatgaaccggtccatgaccgccgacgtgcgggcgccccggcgcgataccgaatgtccgcgtagacaggatgcccgtgcccgtgcagaaccggctgaaaaatgacgtggacgttcttgagctcagcgccgagcacatgcgtacagagctcgacgcagtcgcgcgacagctcggcaagattttcgtcagcaggcatccgctgtgcatcgatcgagaaagtgacgttcggcatcgtgggcttactcctgggcagttgaaagggcgcgtgcgctcgtcagttgctccgtcatcggcgcgtaaaggtgaacgccttccgcgcgttcgtcgacaagcagcgtgttgttgcgcggcacgacggcgagccagcgtcgtgccggaaactgctccagcgcgacggcttgcatggccagcgggtcgaggcccaaccggatcagcggatcagggccgccggcgcacagcgcgaggtgttcgccttcctccaccgccggggccaatccgatagcgccatagagattgcgatgccagtcggtgatgtgctgctgccacttcgcaaaattgccgccgcctttccggcgatattcgtcgccggtcaggacatcgagaccgtcgatcgtgtgaatcgccagatagacggggcaaccgctgccgatcgccttgaaccgctgcgacgtgtgaaaccccgtcaccgagatcagggcaggcagcttttcgaggctgtagaagtcgttccattcggcttcgctgtcgacgtcggcgaagctgcattccacggtgtagatcatcggatcgtcctttgaacagggtgcacttccgtcagcgagcgcttgatggtcagtgcggtaacgtaatgctaagctcgcatttgcagcccataaaacgaaataaagtcagccttcagtgatatttgctcaagctgacgtcgaacccaccctgaccggcgagccacgcatgccccgcaagatcccgagcaattccgcgctgcaggcgttcgaagccgcggcccgacacggcagctttgcccgagccgctgatgaactcgcccgaaccgagggcgccgtcagccgtcagatcgcccggctggaggcgttcctgggtgtcacgctgttcgagcggatcggcaaccgggtacggctggcaccgaacggtgcgcggtacgcggtgcaggttcgcgagattctggaccggctggaacgggacagcctgtacctgatggggcaacccgtcgaaggcgcgagcatcgatatcgccgccattccgaccttcgccacgcgctggctgatccccggctgaaacactttcaggaccggcatccgaacgtcacggtgcatatcgccgagcgcatggaaccgttcctgctggccgggagcggtttcgatgccgccattcatttcgagcatccggcatgggcggggatgcatctgcatccgctgctggaggaagtgctggtgcctgtgtgcagtccggcgttgctggcgggtgccggggcgaacccgtcgctggatgcactgccacgccttcaccggcggcagaacccggacgcgtggcaggcctatgcgcaggagtccggcatcgtgctgggcaattcggcggttggcgcgcgctacgatctccattcgatgctgatcgaagcggcgctcgcgggcctgggtgtcgcgctggtgccgcgtctttacgtcgacgcggagctcgagcaggggcggctggtcgcaccctggccggcgggcaagtccgtcacgaaaaacttctgcctcgtcctgccggaaccgatcgaactgacccaggggccgttgcaggctttcgcgacgtggatgctgaatgacgccccgggcctggcaccgtacggcagcgcgcgacgcacaccgcgaagcagacgtcagcgcggcgcttcctctccacgttgattcgccgcacgcagaccgcgatcgggtgcgctcgctcggcgagacaccgcctgccgaatgctcctgtcagtcgcgcgtatgcgctcaaccgacgggcctgcaaagccccaagaccaaccgtgctgccggcactgaaaaccggttccacccgcgcaatgcgggttcttccacatgatcgtttggtttcctttgcatttttgatgaccattgctccatgacggcaacgcgataaggcacgtcgggggcgacgtgccggtgcaaagccgtcacggcgggatcacaaggcgtcgaggaagatcgatggatctagtggttgatgcacccgttgtcaactgactggagggccctgtctaacaacctgcacagcgttgttgaacgtgattcacttcgcgtgctggtgcgaaaacgttcgtttgtgttcgtttttattcgttttccggcgtcggagtacgtcgggccaagccgtcgcgccaagccgtcgagtcggtacggccgacatcccgcgcgcgggcgacgcttcagtgccggaagcgtcgctgcatcagcgatttccgcatcctcatcctcgagcaactgacatgtacgtaaaaatggagagcaagatgagcagatcgatacgagcgaaagcagtggcgaccgtggtggcaatcgcaatgaacgcggcctcggccgcgagtgtcggaaccattctgtcgctggccggcgcgcaggctgctaccgccgcgacgaccgccgttgacgactatgcggcgacccggtacccgatcattctcgtgcacgggctgaccggcaccgacaagtacggtggcgtcgtcgagtactggtatcgcattccggaggacctgcaggcgcacggcgcggcggtatacgttgccaatctgtccggcttccagagcgacgatggcccgaacgggcgtggcgagcaattgcttgcgttcgtgaagcaggtgctcgcggcgacgggcgcgcagaaagtgaatctgatcggccatagccagggcggcctgacatcgcgttatgttgcgtccgttgcgccggaactggtcgcgtcggtgacgacgatcagtacgccgcactggggctcgcaattcgcggacttcgtccagcaactgctgcagacggacccgaccggcctgtcgtcgaccgtgctcggcgcattcgcgaatgcgctcggcacgttgacgagcagcaacttcaatacgaaccagaatgcgattcaggcgttgtcggtgctgacgacggcaaaggccgccgcatacaaccagaaattcccgagcgcagggctcggtgcgccgggttcgtgtcaaaccggcgcgtcgaccgagactgtcggcggcaatacgcacctgctttattcgtggggcggcacggcgatccagccgacagcgacggtggccggcgtgacaggggccgtcgatacgagcgtgagcggggccatcgatccggcgaacgcgctcgatccgtcgacgctggcactcctcggcagcggcacggtgatgatcaatcgcagcgccggtccgaacgacggcgtcgtgtcgcaatgcagcgcgcggtttggccaggtgctcggcacgtatcactggaatcacaccgatgcgatcaaccagatcctcggcgtgctcggcgcgaatgtggaggatccggttgcggtaatccgcacgcacgcgaaccggttgaagaatcaaggcgtgtaatcgatgacagggagcaagcgcggcatcgcgcgacgccggcatgtccggcgtcgcgcctgccgcgatccgggcgcgatcgggcgggtcgccgtgcatcgggcgattgcttcagcgcgtcgtcgataacggtcaccagggcgtggcttatccgtgcttcggcgcggtcgatacgcgcttcatcgcggaaccgttccggaggcgccggcgcgctgtcgtgacggctatcggccatgcggccgcgtcagtctcgaacgcgtcaggatctcatcgtgcgggcgctgggcgcaacgacgtcgattaccccgcactcgcgagtgtggtgccggtctagagccaccgctctggattcccgttgcgctgccgcataaaacgatcgtcatccgcagggagtgcgcggagaaaatcgcttcgtactccatctaaaaattcatcgcgatccgggagtatgaccgtccagcaaggaatgccgggcgtttgacgatttcattcccggctcgcaggggacgcgctcgatcgtcagattcgcgatccgcattcaagcgacgaatgtgtgcatcgcaacaatccatttcattcacggcaatcgtaacggtaaggtgaacgcacgttcgaatttgatcgagcgatgctaaaccaccctgtgacgatgccatgacaacgaaccgcgatcgacctgccaaagtgccagccccgccttccggtgtcacgccggcaggcggcaatgcgcgtgcggcgggcccgcgcctgccggccaggctggtgggccccatcgtgctcggcacgctgctcaacgcgctgaactcgtcgatgatcgcggtcgcgctcgtcagcatccagcaggcgttcaacccgcacgggcaggaacgcatcgacaccatgtggctcgtgtcgggcctttatctcgcgacggccgtcggccagccgacgatggggcggctcgccgaccggttcggcgcgaagcggatcttctgcatcggcctcgcgatcgtattgatcgcatccgcgctcgcgccgttcgcgccgtcgctcgggtggctgatcgcgtcgcgcgtcgcgctcggcatcggcacgtcggccgcgtatccggccggcatggcgatgatccgcacgtggtcgcagcggcacgcgaacggcgcgacgccgacgggcggactcggcgcaatctcggtggcggcacaggtggccgtcgcgttcgggccgccgctcggcggcgcgctcgtgcagttcgccggctggcgtgcgatcttctggatcaacgtgccgatcgtgctgctggcgttcgtgctggcgtggctgtggattccggccgacgtcgtcccgcgcggcgcgcagcaacgccgcacgctgcggggcacgctgaaggagctggacctgccgggcgtcgtgctgttcgtcctgacgctcgcgagcctgctgctgttcctgcaatcggtcacgcacgatcccgactggctgctgctcgtcgcgacgctggtgctgtgcccggtgctggtcgggcacgagcggcgggccgcgacgccgctgatcgacatccgcatgctcggcgacaaccgtgcgctcacgagtacgtacctgcgttgcgtcggcacctacgcggtgttctacgcgatcttctatgcgctgccgatgtggctgcaggaggccaagcacctgtccgccgccgatgccggcctcgtcatgctgccggtcgccgggatcggcaccgtggcgacgatgctcgcgacccgcctcgcacaccgtcacggctcgcggccggtgctgatcatcggctccgcgatgctgtgcgtcggcagcgtcgtgatgagcctgctcacgagcgcgatgccggtctggtcgatcgtactgctatcgatcgtgttcggcgtgccgaacggcttcaacaatctcggcaaccaggccgcgctctaccagagcgcgccgcacgaccggatcggcacggcctcggggctgtaccgcactgcgcagtatgttggcggcagcctgtcgtttgcgctcgtcgggctggcgctcggccatccggcgagcgatcgcggcctgcgcgagctggccatcgtcctggcggtcatcagcgtgctgctgctgctcaacgcagcgtcgagccggcacctggataccgccgcttcttccatccccaacagaagtgaggttttgacatgtccactccgacgctcaatcgcacggtcgccctggtcgccatcgatctgcagaacggcatcgtgtcgctgccggtcgtgccctacaccggcgcgcaggtcgtggcgaagacggtcgagctcgcgaccgcgttccgcgcattgaagcttcccgtgatctacgtgcacacgagctaccagccggacggcggcgtcgcgctgaaggtcaggacggatgcgccgtcggcgccgccgaatctcgaccccgaatggagcgcgtttgcgccggcgctcggcgtcgggccgtccgacatcgtcgtgacgaagcaccagtggggcgcgttcaccggcaccgacctcgacgtgcagctgcgccggcgcggcatcacggacatcgtgctgaccgggatcgcgaccaacatcggcgtcgaatcgacggcgcgccaggcatacgagaacaactacaacgtcgtcgtcgtcagcgacgcggtcagcacgtcgtccaccgacgcgcagactttcgcgctgacgcagatcttcccgaagctcgggcaggtcgccgcgacggccgacgtggaggcggcactgaagcaggcgtattcgcgctgaacgaagcggcgtgttcggcgtgcaccattcaaacagagtcatttaccgaggcatgacgatgatcaagaccgatgcatgggttctctacgcaggaccggaaccgagcaggaagcaggcgcccgtggcgggcgagctgcgtcgcgagaccttcgaattctccgatctggaagccgacgaggtgctggtcgagccgctgtacggatcgtgggaggcgaacctcgaccacgcgctgtcgcgcaatccggtcgacatctgccggcagcgccgcgaggacaagatcgtgctcggcaacggtgcgctggtgcgcatcgtcgagcgcggcagcggcgtgaagacgctgaaggaaggcgagatctgcatggtgatgccgttcggcaagcgcgatgaatacgggttcgccgagctcgtctacgcgtacgacgcgccgggcacgatcggcgtgatggcgcagcggaccaagatgcgcgccgacaacctcgtggcggtgccgacggacagccgtcattcgctgctgcaatgggcgacgtacggccgctacttcaccgcgtgggacaactggaaggtggcgtcgacgtgctggcgctcgcaactgccggatgtcgatccggccgactatctggtgttcggctggggcggcggcacgacgctcgccgaactgcagctcgcgaagcgcgagggttttcgcgttgcgatgacggcgagcaacgaccggcgcctcgaggagctcgcgaagctcggcatcacgccggtcgatcgccgcaagttcccgaacctcgcgtatgacgacgagcgctacaagaccgatccggagtaccaggcgagctatcgcgagtcggagcgcgtgttcgcggagacgatcgcggagctgagcggcggccgcggcgtcgcgatcttcctcgacaacctcggcggcgcgctgtatcgcgcgacgatgcgtgtggtcggccgcacgggtatcgtcacgacggtcggctggaagaccgggatgcgcctgtggaacctgcgcgcgacggagtgcatcaaccgccgcctgcacatccacacgcacgcgtggcgctacgacgatagcatcacgatccgcgatttccaggaagcgagcggctggatcggcgaggagccgaccgagatcttcgatttcgacgaggtgccgaagctcgcgtccgactacctgaacgggaagatccagacgtatttcccgatctaccggatcaacgccgtctgagcggcaggtcgcgcgccgcgcccgcatcgctgcaagacgattagtcatgcagatgatggcggtgtgcggcgcgccgtgcaatccatctgactggagaacggcatggccactgtggaaatgggggcgtcgacgccggtgcggcgtcggacgcgtccaaaccggcgccgctcgacggcattcgcgtgatcgacgccgcgacgttgttcgcgggcccgctcgcggcgacgatgctggcggactacggcgccgacgtgatcaaggtcgagcatccggacggcgatccggcgcgcaagtacggcgcgcgtcgcgacgacgtgccgttgtggtggaaggtgctcgcgcgcaacaagcgggcggtcacgctgaatctcggcacggccgacggccagcggatcttccgcgagatggcggcgcaggcggacgtggtcgtcgagaatttccggcccggcacgctcgaacgctgggggctcggttacgacgtgctgtccgcgatcaacccgcggctcgtgctcgtgcgggtgacgggcttcgggcagttcggcccgtatgcgagccgccccggcttcggtacgctggccgaggcgatgagcggcctcgcgtcggtcaccggcgaggccgacgggccgccgctgctgccgtcgttcccgctcgcggacaccgtcgcggggctgaacgccgcgttcgcgatcatgacggcgctgaaggcgcgcgagcacaccgggcgcggccaggtcgtcgatctcgcgatcatcgagacgatgctcgccgcgatgggcgcgcaggtcgcgagctacgaccagacgggccgggtgcccgaacgcaccggcaatcgttcgccgaacaattcgccgcgcggggtgtaccgcacgtcggacggcaagtgggtcgcgctgtcgacgtcggcgcacagcatcgcggagcgcgtgatgcgcctcgtcggccgtgaggacctgatcgacgaaccctggttcgcgaacggcgccgagcgcgcgaagcatgcggacgaactggatgcggcggtcggcggctggatcgggcagcgctcgcgcgacgacgtgatcgccgagttcgagcgcgcgcaggcggcggtcgcgccgatctacgacgtcgccgacgtgctccgcgatccacagtacgcggcgctcggctcggtcgtgtcggtgcccgacgcggagctcggcgcgttccgcacgcacaacgtgccgttccggctgtccgacacgcccggcgcgatccgctggggcggaccggcgcgcggcacgcacaacgacgaagtattcggcgcattggggctggagcggcacgagatcgccgatttgaccgaacggggcattgtatgaaaaccagcgcaacctaccgcagttacctctacgtgcccgcgcacaaggcgcaggtggtggacaaggcgtatgcgagcgaagccgatgccatcgtgctcgacctcgaggatgccgtgccggccagccacaaggccgaggcacgcgaggcggccgccgcgattctcgcggaaggcccgccgaagccgacctacgtgcggatcaacccgatcggcagcccgtggtgccgcgacgacgtcgacgcgatcgcgcagccggcgcttcaggcgctgcgcctgccgaaatgcgacctgccgcagcatatccaggaagtggccggctggctcgacgcgctcggcagcgatgcgggcatccagatcctgatcgagtcggcgtacggtgtcgagacggcttaccagctcgcgaccgcgtcgccgcggctggagcgcatcgggctcggcgagagcgacctgcgcgcggacctgcagatcggcgtcgacaacttcacgctcgaggtgtgccgcgcgcgctgcgtcgtggtgtctcgcgcggcggggctcgtcgggccgatccagaccgtctatcacacgctgcccgatctcgacgggctgagggaatcgacgctgcgcgccaagtcgatggggttcctcggccgcttcgcgattcatccgtcgcagctcgcggtgatcaacgaggtgttcacgccgtcggaagacgagatccgcgcggccgagcgggtgctcgaggcggtcgatgcggcagcgggcaaggcctcggcgtcgtcggtcttcgtgctgccggacggccgcgtggtcgcgccgccgctgatcgccaacgcgcgcgtgacgctcgcgctcgcgaacaatcttcgactcagtggagcactggcatgagcacacccgagacgctttccgctccggcggccgcggccgatccggtcgcaccggaccggcccgcgcccccgacggcatcgtcggcgcgctcggccgctttgcggcggaggtgcgcgccggagggctggaataccggctgcgcgtcgaggccgccgcgcgcgtgctcgacgtggtcggcaacagcctgatcgcgcacgacgaaccggtcgtgcagtcggtgctgcaagtcgcgcggcgctgggcgggcaccggcccggcgagcgtgatcggcgcgcccgaccggctgccggccgcaagtgccgcgctcgtcaacggcacgctcgcgcatgcgatggatttcgacgattcgcacatgctgtcggtgctgcatccgagtgcgtcggtgattccggccgcgctcgccgccgcgcaggcgagcggcgcgtcgggcgcggcgctgctcgatgcgatcacggtcggcaccgaggtgtgcatccggctgggcgtcgccgcctacaacgagcggctcggcaactcggtgtttttcgagcgcggccagcacgcgacgtcgatctgcggcacggtcggcgcggcggcggccgcggcgatgctgctcgggctcgacgccgcgcagatcgcggcggcgctcggcattgccgcgagcatgggcgcgggcctgctcgaagcgaaccgcaccggcggctcggtgaagcggatccactgcggctgggcggcgcatgcgggcgtgagcgcggcggaactggcgggcgcgggcgtcaccgcgccgccgaccgcgctcgaaggccgcttcggcttcttccacgcgtggtgcggcgaccttgccgacgtcgacgcggtgctgcgcgacctgggcgacgaatgggagacgagccggatcatcttcaagccgtatccgtgcaaccacttcacgcatccgggcatcgacgcggcgctgcaactgaaggcgcaaggcgtgacggcggacgacgtggtgtcggccgagctgcgggtcgcgacgtcgacgctgcgcacgatcggcgagccggcggagttgaaggcgaatccgccgaacggttatgcggcggcgttctcggggccgtacacggtcgcggcggcgctgctcggcggcggcggtctcggcgtctggttcgacgatttcgacgatgcgcttgcgcgggaccccgcacggcgcgccctggctgcgaaggtgcgttgcgtggccgatccgtggtgcgatgcgcgcttcccgcatttcctgccggcggtgctgcgcgtcgagctgcgcgacgggcaagtgcgcgaggcgtggatcgagtcgagcaagggcacgaattcgcggccgctgaccgaacaggaactcaccgcgaaattcgtgctggcggcgagttcggcgctcggcatggagcgcgcgctcgcgctgcgcgacgcggtgcggtcgctcgccgacgatgcgccgctcgatgcgctcgcggcgctgacgtcgggcacggaaggaggacaccgatcttgaatgcaccccgctggaaaaagcggccgcccggctcgaactggggcgacttcggtcccgacgatcagaaggggcggttgaactggctgacgccggacaaggtgcggcagggcgcagccgaagtgcgggaggggctgtcgttctcgctgagcctgccgctcgacgtgccgcgcggcggcgggctgaacgcgcggcggcggccgccggcgatcatgccggcgctgctcggcgacaagccgtatttcggctatcgcgcggacgaacaggttgcgaacgcaaccgatgtggtctgcgacgattcgttctgcatgcactcgcagttctcgacgcaatgggacggcctgtcgcacgtgggcggcgtgttcgacgcggacgacgacggcgtgcctgaaatcgtgttctacaacggcttccggatgggcgagcatctgcgggtgccgcaagagggcgacgcgacgggcggcgcgcgtgcgctcggcatcgaggtgatggcgcaaacgggcgtgcaggggcgcggcgtgctgatcgacctgcggcgtcacttcggcgacgcgcgcacgaaggtcggcttcgcgcaactgatgcaggtgatggaggcggaccgcgtgcaggtcgagcgcggcgatatcgtctgcattcacaccggctttgcggatctgctgctgcatgacgacggcggatcgccggcgacggtcgcgagcgcgtgcgtgctggacagcagcgatgcgcggctgctgcgatggatcgacgaatcggggctggccgcgctcgtggccgacaaccatgcgatcgaggaacgtccgcaacatgcgcagccgctcgcgcaaccgggcgcgctgatgccgcttcatgaactgtgcctgttcaagctcggtattcacctcggcgagctgtggcacctgacgccgctcgcgaactggctgcatgcacacggccggaaccggtttctgctgaccgcgccgccgctgcatatccgcggcctggtcggcgcaccggcgaatccggtcgcgaccgtttgagcttgcgggcggccgccggggcggcggtcgcccgcatttttgcaatgcgacctttttcaaaaatcgcgaatcaaatggccgattggcacggtatccggaagaatcgatgcgaaacggacccactaatttaaaaattaaccaataccgctcgatacctaaaaatatagatacgtcaagattggactattcttgtgcattgcactaaatatcagggattgctccgattgcggaatttcgcgatcgcaatcggaggcggtgtttaacctgtttagtggatggtcgcaaacatgaatctacgttcgatcgatctgaacctgctggtcatactcgatgcgctattgacggagaaacaggtcacacgggccggccagaaggtcggcctcacgcagccggccgtcagcaacgcgctggcgcggctgcggttcctgttcaaggacgagatcctggcgcgtaccgcggtcggcatggagttgacgccgcgcgcacaggcgctggcgatgccgattcgacagatcatgcaacaaatcgaggaattatttgaatcggattatcaattcaatccttttacgtccgagcgccatttcacgttgcgcatgtcggatctcaccgaattgcttttgctgccggctctgctgcgctgtatgcgcttgaccagcccgaatatcggcatggacgtcgtgcacatgagtgccgccaagaccgccgacgcactcgaatcggggctgctcgacctggcgatcagcgccggccttgaacattcgggcgcgctgtcgtcgcaaatcgtgtttcatgaccggatggtctgcgtgatgagccgcagccatccggaagcgggcacgccgctgacgcttgaacggttcctcgcgctcgatttcctcaacgtgacgatcaatccggtcgaccacagcctggtcgacaacctgcttgcgaacatgaactgcacgcggcgcatcgcgctcaacgtgccgcactggctcgtcgtgccgaacatgctggatgcgctgccgtacgcggtgatcatgtcggagcggcatgcgctgagcctcgacgatgcacggctcgtgatccgcgacctgccgctcgcgatggagcccgtcgcgtggtcgctgtactggcaccggcgctacgacggcagcaacgcgcacgcgtggctgcgcagccgcatcgtcgaggtcgcggaagcgctcgaacggcacggcgtcgcggcggaagcttagggttcgttcacgcaggtcagccgacgacgagcagcggcggcagcgtcgcgacgtcgggctgctcgtcgagccgccacaggtaatcgagcgccgcgcggatctgcgccgggccccagtgccgccggcagttcttcgcgaacttcgcctcgtagtcgtcgcgccgcatcggccgcgtcggcgagccgggcaggtcgtccacctgcttcgtgcagaccgacccgtcttcgcacacggccgtcacccggttcggcgcgtgcgcgggatagcgggcggtcagcgccgggtcctcgcgcaccgtgatccgctcgatcaatgcgcgcagcgccggatcgtgcagcgcgtcgggccggtagctctcggtcgtgatgtcgccgtcgagcatcgcgcgcgcgacgatgtacggcaggctgtgatcggcggtctcgtgggtcgacggcgcccatttttcgcggtcgcggccggccgtcacataaccgacttcggtcgtgtcgatctcgatgcgccggatccggcgcaggtcgccgacctgcgcggcgacgtcgagcgccgccggaatcgcggtttgcgtgagcccttgcgcgggatagaacttcacgaagcacttgccgatccggaacgcgccgccgcgcccgccgaattcgcgcgtgtcgacggcgaacggcccggacacctgcggaaagaatcccgccatgccttcgaaaatcggcgcggggccggtcagcccggcccgcgcgagctgcgtcgagaacaccgcgttgcgcgccgcgtccgcatcggcgagcgccttccagttcgacaattcctggacgcgcgtctggttcagcgcgagatggctgttgatcgacaggttcaccgcctgcaccagctgcggcgcgggcatgcgcatcagcttgcccgcggcgagcgcgacggcgggcaggctgtagcacgtgtggtcccagccgcgcgggctgatcgcggcggcgtccatcagccggcacgcgatttcgtaggcgatcgcgatcgacaggatcaggtcgcggccgttcgcatgctgcgcttcggcgaccgcgaggcacgcggacatgttgtcgctcggatggccggtctccttgccggcgtacgcgtcgttgaaatcgtagtagcgcagtgcggtgccggtcgcgaacgcggcgagatcggggctcgtgcgctggttcgtgccgacgatcgtcgacacgccgcccggcgacgcgagcgccgcgtcgcgcgcgatgcgtaccggacgttcgtcgtgcgcggcgatcgcgcagccgagcgcgtcgatcaggtgcgccttgatcgtttcgatcgtcgcggcgtcgaggtcgcgatactgcagcccggccgcgtagtcggcgagctgctgcgcgagatcggggcggccggaggtggcgccggcggccggcagcacgcccgcgcgggcgtgggcgaacggcagcgcgagcgccgcgccggtcagcgtggaaaggaagtggcggcggttcattgtgcgaagactccgaaggttcctgaggctggggagaggcgaggtcagaacagcttgcgcaggccgagtgccaggcccgcgctgctggcacggtcgccggccagcgtgtagtggaggaagttgtagttgtagttgtcgaaatcgagcgcggcgcggcgcgcgtagccgcccgccaggtacagcgtgacggctttcgacaggaagtagttcagctgcagcgtgacctgttgcgggttggccgggtgcggcgtgggtgtctgcgcgttcggcgcattctgcgcgcggatgtcctcgtaatagaacgcgccgatcgcctgcaggtaaggggtgatcgcgtagcgcacgccggcccaccagaacgtgtagcgcgtcacgaccgatggcgcggcgacgccgctctggccgtgcgtgacgccggccagcagttgcgcacgtccgatggacgcgatcgcggcagcggcgtagcggcggaaatgcgcgaagccgcccggctgcggggtgttgacgttgtcgaacgcggcggcgagcgagaatgcgccgccggcatagtcgaagccggcgccataggcggcgttcgactggaacgcgccgggcgttccgccgaacgaatagtgcgtttcgagcgtcagcgggccgatcttcgccaggtacttggcgacgttgttctcgcggaagttgacgccgacgatcgcgccggccggctcgtacagcgtcgagtacgcgcccgtcggcgaatagcgctccatgacgtcgaacagcgtcgtgtactggtggccgagccgcagcgcgccccagcgctcgtgctgcagcccgacccatgcggagcggtcgaagccgcccgcgccggtgccggtaccgttgttcaggttgatgccgctttcgagccggaacgcggcctgccagccgccgccgagttcctcgacgcccttcaggccccagcgcgagccgctcttgccgcccgacgccatccgcacgagcgatgccgacgacttgtcgccgggcgcggcctgatgggtgaggaattccgtatagatgtcggccacgccatacagcgtgatcgtgctctgcgcgcaggcgccggccgatacgaggcccagtccgcacagtgcggacatccgcttgcccatggtttgtctccttccagggtttgttctttgtttgagttcggcgccgcgccggtcgagcggtgcggcggtgctgcggggcgacgctatccgggccgggtagtgaacggacggcatcgtgacgggcgcgtgcgcgcaccgcgcgacgcgcgcatggacgcgcggcgatgaagggggcgcccgcattaccggggcacgccgtcggcgcgcgcctgtaccgccgcgtgacgtgcgagcacgcgcttcgcgcgggcgacgccgggcgcgtcgaccatccggccgtcgacgcgcagcgcgccgcgcccgttcgcgcgtgcgtcgtcgtaggcggccagcaccgcttgcgcgtcgcgcaccgcggcgtcgtcgggccggaacgcacggttgagcgcgccgacctgcagcgggtggatgcaggtcgcgcctgcatagccgagctccgcggacgcgcgcgcgatgcgctcgaacgcgtcgagatcgcgcagttcgtcgaggccgccgatgaggccgagcggcaggatgccggcggcgcgcgcggcgatgatcagcaactgtttcggcacgcgcagcacatcggcgctcgcaccgctttcgcagttcagtgcgaagtcgccgccgcccagcatcatcgcgacgacgcgcggcgatgcctgcgcgatccggtccattgcctggaacgcgcgcggcgtttcgacgatcgcgacgatccgtgtgcggccgggcggcgcgccggcttcttcttcgagcgcggccagcagttcgtcgatcgcctcgatgtgcgagccgccgcgcaccttcggcagcgcgacgccgtccacgccggcccggacggccgcgcgcaagtcgggcacgagctggtcgagcgggccgttggcgcgtaccagcaagtcgcggcccggcgcgcgcagcgccggcacggcgtcggccagcccgtcgcgggcggccgccttgcatgcgggcgggacgctgtcctcgagatcgaggatcagcgcatcggcgtcgctcgcggcggccgatgcgacgaaacggggacgtgcgcggggacgtacagcagcgagcgccagacgggttgtgatgatgaattcatctacggtctcataaaatgaaagtcactttcatttttgtgatggatgaccgcattcgtcaagattatcgttaacgcctagtatcaaggaacattgcaggatgatgaccgagcgaagctctgcggattcatgttgatgtcatcgatgatctgcgtataatgaaagtgactttcatttttcgatgctggccaccgtaacgtggcaccgacctgccacgaacagcccggcatcgcacgaggtggacatgaacaaggtggagacaagcagtccggcagagggcggcgtggccgcggtcaaccgcgcgctgaccgcgctgctggcattcggcaacgcgcccggcgggctgatgctcgcgcaggtgagcgaggagacggggctcaacatgagcacgctgttgcggatgttcgagtcgctcgagcagttccgcttcatcaagcgcctgccggacgggcgctatgtgctggggcccgccgtgttccagctcgggatgatgtatcgcgagtcgttccagctgcgcgagtacgtgatgccgatcctgtcgaggctgtcggcggaaaccggcgagacggccgcgttctacgtgcgtgaaagcgaccagcgcgtgtgcctgttccgcatccaggcgcagcgctcggtgcgcacgcacctgcgcgagggcgaccgcttcccgctcgacgtcggcgcggccgggcgtgtgctgcttgcgttcagcggcacgcgcggcggcgactacgagaagacggccgagcagggctacgcggtatcgatcgccgagcgcgatccggaaagcgcggcgatcgcgtgcccggcattcggcgtcggccgcgtgctcagcggcgcgatctcgctcggcgtgccgcgttatcgcttcaacaagaaggtgctggccgactacctgccgcgcgtgcaggcggccgccgtcgagctgacgcatgcgctcggcggcgatctgcccgccgcaggcgcggcatttcgcgcggccgaccagctcggcgcgctgctcgagtagcgccgcgcgcggctgagcgcgcctcgaagtccgccttgcagtccgcctcgcacgacgcatacaccaaccaggagacaagcatgttcgttcccgacccgcaggccgctcacgcggccggcgcgcaccgtcgcgcgtccaccggcccgattcatccgaaaccgttcgacgccggcgcgcaggggccgctcgcgggcgtgcgcgtcgtcgacctgtcgcgcctgatggccggcaacatgctgagcgtgcagctcgccgatttcggcgcggatgtcgtgaaggtcgagagcgagcgcggcgatacgctgcgcgcggtcggcgcgggcgggatcagcacgaactggaaggtatacgggcgcaacaagcgcagcgtgtgcgtcgacctgcgcgcgcccgagggcatcgacatcgtccgccggctggtgcgcgacgcggacgtgttcgtcgaaagcttcaagcccggcgtcgccgagaagatggggctcggcccggacgacctgctcgcgatccgtcccgagctggtgatcgcgcggatctccggctggggcagaccgggccgtaccgccacaagccgggcttcggcacgctcgcggaaggatatgcggggttcgcggcgatcaacggcttcgccgatcgcgagccggtgctgccgccgatgttcctcggcgacatgacggccgggctgtccggcgcgatcgccgtgctggtcgcgctgcatgcgcgcgacgcgcacggcgcggcggggcaggtgatcgacgtgtcgctgttcgagccgctgctgtcgatcctcggcccggccgccgcgaactacgtgatgaccggcaagatcaaggaacgcaccggcagccgctcgtcgaacaccgcgccgcgcaacgcgtatcggacccgagacggcaagtggctgtgcctgtcgagttcgacgcaggcgatggccgagcggctgttccgcgcgatcggccgcgcggagctgatcgacgatccgcgctacgcgaccaacgtgcagcgcgtgcagcacgcggaagcgctcgatgcgatcgtcggcgaattcatcgccgcgcgcgatctcgatgccaatctcgcgttcttcgaagaagcgggcgtgacggtcgggccgatccaggatatcgcgcagatcgttcaggaccgctatgtgatcgagcgcgaggcgctcgtcgagctgccggacgacgacgtcggcagcctgccgatgcacaacatcacgccgcgcctgtcggccacgcccggcacgttccgccggcccgcgcccgcgctcggcgagaacaatcgcgagatcctgctgccgctgctcggcgaacgcgaatacgagcggctcgcggggctgggcgtgatccgcacgcggtaggcgcgacgtgcgacgcggccgcgaaggacggccgccgcaccctggacattgcatggaggagacaaccatgaagccacgctggacccatcggccgcccggctcgaactggggatttcggcccggacgatcagaaagggcgcctgaactggctgaccgccgacgcggtgctgcgcggcgtcgcggaagtgcgcgaaggccgcgtgttttcgctgagcctgccgctcgacgtgccgcgcggcggcgggttgaacgcacggcgccggccgccggcgatcatgccggcgctgctcggcgacaagccatacttcggctatcgggcggatgaacaggttgcgaacgcaaccgatgtcgtctgcgacgattcgttctgcatgcactcgcagttctcgacgcagtgggatgcgctgtcgcacgtcggctcgctgttcgatccggcgggcgacggcgagcgagcccgcatgttctacaacggctaccggatggacgagcacatccaggtgcccgaagcgggtgcgccgcgcggcgcgcgcgcgcgctcggcatcgaggtgatggcgcagacgggcgtgcaggggcgcggcgtgctggtcgacctgcggcgccacttcggcgacgaacggcgcaagatcggctacgcggagtggatggcggtgctgcgcgcggacgacgtgatcgtcgagcgcggcgacatcgtgtgcgtgcatacgggcttcgccgatcgcctgctcgacgccgacgcgcgcggcgaacctaccgcgccggacgtgtgctgcgtgctcgacggcgacgacccgcgcctgctcgaatggatcgacgcgtcggggctcgccgcgctcgcggcggacaaccacgcggtcgaggagcgaccgcgcgatgcgcgggcgcgcgagcggcccggcgcgctgatgccgctgcacgagctgtgcctgttcaagctcggcatccacctcggcgagctgtggcacctgacgccgcttgccgactggctgcacgcgcaccggcgcaaccgcttcctgctgaccgcgccgccactgcatctgcgcgggctcgtcgggtcgccggtcaatccggtcgccaccgtatgaacgccggcgccgcgcgcatgtcgcgccggcgccgggtctgccgcttcgccgcttcgcgcaggccgcgcgggcggatcatcgaggaatcgccatgtcccattcccatgcggcgtcgatcgccgcccgcatcgaccgcctgcccgcgacggccagcatctggacgctcgtgctgttcctgagcgtcggcgggtttttcgaggtctacgacctgttccagatgacctacctgccgcccgggttgatccgcgacggcatctttcacgcaggctcgcacggcgtgctcggcatgtcggaccagggcgcgctcggcgcggcgacgttcgccgggctgttcgtcggcgagatgttcgtgtcgcgtctcgcggaccgcttcgggcgtcgcgcgctgttcaccggcgcgctgctgctctacacggcggcgagcctggcgatgtgcgtgcagacgcatgcgctcggcatcctcgtgtgccgtttcatcgcgggctgcggcatcggcgcggagctgatcacgatcggcgcgttcctgaccgagctggtgccgaaggcggtgcgcggccgcgcgttcgcgctgtgcttcgcggtcggctatctcgcgatgcccgtgctggcgctggtgtcgtggttatgggtgccgcacgatccgctcggcatgtccggatggcgctgggtcgtgctgctcggcggcagcggcgcggttttcgtctggtggctgcagtcgcggttgccggagtcgccgcgctggctcgcccacacggggcgcgaggccgaggccgaagccgtgctgcagcggctcgagcaggccgtcgagcgggaatccggccggccgctgcccgcagtcccgacgccggtcgcagcggccacggccacggccgtgcagcgcgcgccgtcgatgtgggatgcgcggcatcgcggccgcacgacgatgctgatcgcgttcaatgcattcctgagcatcggtttcttcggcttcagccagtggctgccgacgctgctcgccgcgcagggcgcgagcgtcacgaagagcctctggtatgcgttcgtgatcgcgttcgcgtatccggtgtcgccgttcgtcgccggcctgctcgccgaccggatcgagcgcaaatggctgatcgtcgcgtcggcgttcggcgtcgcgctgttcggcaccgcgttcgcgatgtcggcgcaggcgccattcgtgatcgcgttcggcttgctcgtcacgctgtccaacacggtgctcgcgagcaacggcaccgcgtaccagtcggaagtgtttccgaccgagatccgcgggcgcgcgctcggcttcgtgcattcgatcggccgcctgacggggatcgcgagcagtttcatcgtcgcgctgctgctcgaacgcgccggggtgtcggccgtgttcgtgctgatcggcggcagcatgctgatcgtgatggtgtcgatcggcgtgttcgggccgcgtaccaacaaccgggcactggacgagatcgcggacggcgccgagcacgcggcggcgttgcgcgggctcgccgaagcgccgaccgggcgtgtcgatgggcggcgaaaattgggctagcatcctgattcaacacggcaaccggggtatctcgcccatcgaccatcgccatgaaacccgttgccgtcgtattgcacggcccgaccagtgcagggaagagcagcctggccagggcgctccagcaagggtcggacgtgccgacgtttcacgtctcgctcgacgcgttcgtcgagatgtcgcgccgacgtgacatgcgatcggacgaggagctgaatcaggcgctgagactccaccagctcaacctgcagtcgacgctcgcacggatcgcggccagccatttcgagatcgtgctggatctcgtgctccgggatccggccgcgctcgacgcatgcattgccgcgctgtcgccgcgtcagaccttcgtcatcggcgtgacgtgcccgctggatatcctcgaacagcgcgaacgcgcgaggccggatcgcggcgagggcatggcccgctcccagttcgggcatccggcttattcgcggccttacgcgctgcgcatcgacacgtcgacatgcacgccggaagagggcgcgcgccgcatccgtgcccacgtcgacgcgcagcgcgagtgagcgtcgtcgcgcttgatcctgacaggctgcgttctcccttaaactcgccggcaccgaatgtcatcggccacgcggatgatgtcgttcgcacgcgacaaatcgcattgtgccgacaagcgggaaattcgcgatgaaaccgattccgaagcgttcatgccgataaccggttttgtatgtttcgaacgaattgaaagcgaatttcaagcggattcacgcgccgacaggccgtgcgaagcggttccagcgggtaaacgccaggttataggcccgtcgtgtccagacagggattcatggattgaatgcgcgccgattcaaaatataaatttcggaaagactttggcacgggatatgcttcgcagttcttatccgaatgaatcatgcgccggctattcgtcggaaaaatcaggctggagcatgaaccgcccggatctgacaagccgattgtttagaggatgaacagtttgtgaattcggcgcggcagtgcgaagctgcccgcggaacagcgtcgtacacggattgagttgggtgacttgaaacgcaggccgtaactcctagcgacggccactactgacagttcaggatatgacattactgattggggtccctctggagacggccaacgaggaacggcgcgtagcgacggttcccgacgtggtcgaaaagctgatcaagctcgggttctcggtggccgtgcaaagcggtgccggcaccggcgcgaacttcagcgacgacgactaccgtacggccggggccgaagtcgtggcgacggccgccgatctgtggggccgcagcgatatcgtcctcaaggtgcgcccgccgagcagcgaggaagtcgcgctgttgcgtgaaggcagcacgctggtcggcttcgtctggccggcgcagaaccccgaactgatgcagcagctggccgcgaagcgggccacggtgctggcgatcgattccctgccgcgcacgctgtcgcgcgcgcagaagatggatgcgctcacgtcgatggccggcgtgagcggctaccgcgccgtcatcgaggcggcccatgcgttcggccgttacttcaacgggcagatcacggccgcgggcaaggtgccgccggccaaggtgttcgtcgccggcgcgggcgtcgccggcctcgcggccatcggcacggccgccggcctcggcgcgatcgtgcgcgccaacgacacgcgcgcggaagtggccgaccaggtcaagtcgctcggcggcgaattcgtcaaggtcgactacgaggaagagggctcgggcggcggcggttatgcgaaggtgatgagcgaaggcttccagcaggcgcagcgcgcgatgtacgcgcagcaggccaaggatgcggacatcatcatcaccaccgcgctgattccgggcaagccggcaccgaagctcatcacggccgagatggtgcaatcgatgaagccgggcagcgtgatcgtcgacatggccggcgagcagggcggcaattgcgagctgacggtgccgggcgaggcggtggtccgccatggcgtgacgatcgtcggctacacggatctcgcgtcgcgcctggcgcgacagtcgtcgacgctgtatgcgaccaacctgctgcgcgtgatcgaggagctgtgcaaggcgaaggacggcacgatcaacgtcgacttcaatgacgacgcgatccgcggcctcacggtcatcaaggaaggcaacgtgacctggccgccgccgccgatccagcagccggtcgcggcaccgaagcccgccacgccgccagtcgcggcagccgcgtccaaggggcacgggcacggcagcggcgagccgatgtcggcgaagtcgctcgcgatcgtgttcgccgtcggcgcactggcgttcctgctggtcggccagttcgcgccggccacgttcctggcgcacttcacggtgttcgtgctggcctgcttcgtcggctacatggtgatctggaacgtcacgccgtcgctgcatacgccgctgatgagcgtcaccaacgcgatctcgtcgatcatcgcgatcggcgcgctggtgcaggtcgcgccgccgctgggcgaggccgcggccggcgaccggccgtcggggctgatcctcggcctggcggtgggtgcgctgacgctcacggccgtcaacatgttcggcggcttcgcggtgacgcgccgcatgctggcgatgttccgcaagtaaggagacgacaacaatgacttccaacctgactaccgtctcctatatcggcgcggccatcctcttcatcctcagcctcggcgggctggcgaaccccgagaccgcgcgccgcggcaacctgctcggcatgatcggcatgctgatcgccgtgctcgccaccgtactcggcccgcgcgtgtcggccgaaggcattccgtatgtcgtggccgcgctggtcgtcggcggcgccgtcggcctcgtcgccgcgaagaaggtgcagatgacgcagatgcccgaactggttgcgctgatgcacagcctggtgggtctcgcggcctgcctggtgggcttcgccagctacatcgatacgtcggtgcagttcagcggcgcggagaaggccatccacgaagtggagatctacgtcggcatcctgatcggcgcggtgaccttcgcgggctcggtcatcgcgttcggcaagctctccggcaagatcggcggcaagccgctgctgctgccggcgcggcactggctcaacctcgccgcgctgctgatcgtgatctattacggtcgtgcgttcctgcatgcggagacgatccaggacggcatgacgccgctcatcgtgatgacggtggtgtcgctgctgttcggcgtgcacatggtgatggcgatcggcggcgcggacatgcccgtcgtggtgtcgatgctcaacagctactcgggctgggcggcggcggccaccggcttcatgctcggcaacgacctgctgatcgtgatcggcgcgctggtgggctcgtcgggtgcgatcctgtcgtacatcatgtgccgcgcgatgaaccgcaacttcatcagcgtgatcgcgggcggcttcggcaccggcagcggtgcgcccgcggcggcaggcgccggcgcgcagccggccggcgaagtggtggcggtgagcgcgctggagacggccgaactgctgcgcgatgccaagagcgtgatcatcgtgcccggctacgggatggcggtggcgcaggctcagcacacggtgcatgaactcacgaaggtgctgcgcgagaagggcgtcgacgtgcgcttcgcgatccatccggtggccggccgcatgccggggcacatgaacgtgctgctcgccgaggcgaaggtgccttacgacatcgtgatggagatggacgagatcaacggcgatttcccggaagccgacgtgtcgatggtgatcggcgcgaacgacatcgtgaacccggccgcgcaggaagatccggccagcccgatcgccggcatgccggtgctcgaggtgtggaaggccaagacctcgatcgtgatgaagcgcagcatggcgtcaggttatgcgggcgtcgacaatccgctgttctacaaggacaacaaccggatgctgttcggcgatgccaagaagatgctggacgaagtcttcggtgcgttgaaggcctgacgaggcgcacgggcgtgggcgtatgggtgcgcgggtcgaacggtcagcggccgtggtgtcgaacggcgggttgatcggggcccggcacgcccgacgtgcgtatcggaaagatcacggaagtgcgagacgggatcggatgtttcgcacttccggaaaaagagcgcgatcgatcgtcggtgcgcggatcgatgaaccatgcgaatgatgccgttggagcgggcggcggctccatcatcggcgtgacgattgccgaagcctggccggccgccggagtgatgctggtcgaccgctgtcccgtgtgaacgtgctatcgcacctatccgcacgaatcaggcaccagatcctcgcctgccgccgataccgcagtttgctgcaaacggtaccggcgcctctcctcctcgttcctcatgtcacgcacccgcgccggtggttcccacacgactgagtgtgacgatgtcgtctatccagccgctcccagttccgcgaaaccggtgatccttgcgtcgcatgcgcgcgccagcgccaggtcgtgactcgaaaaagacggcacggtccgcggccaacgtcctgaacaggtcgacgagcaccgcacgcgacgcggcgtcgagcccgttgcccggttcgtcggcgatcacgacggtaggcgcgccgagtgtcgtcgccgtcaggaacagtttcttgcgcgtgccgagcgacatctgctcgaagcgcttgtccatatgcggggcgagcccgaatcgatcggccagctcgagcgtgcgggtgtcgacgacggttttcttggccgcggccacgagatcgagaaacgcgcgtccggtctggaacggatacgtcaggcaatcgtcgggtacataggccagcgcggatttcgccgcgagcggcgcggtgcgcagggaatggccgccgagccagacttcgccttcgtccgcgtcgatcgtgcccgcgagaatgccgagcaacgtcgatttgccgctgccgttttcgtcgcacagcgccacgcacccggcgccggatgcgaagttgagcccttggaagatgacgcgcttgccgagattgtcgaagcggagcatggatcgggtaatcaaacgaaaacttgccaggccagcgtgacccagaccacggtcagcgcgatgcccagcaacacggattgtcgggacgcgtagcgttgcggcagatagtgtaatgcgacgagcggtgcgcccgagcacacgagcgccgccgccatctgcgatgacagcacgccgtgcgtcaccagcaacagcggggcgacggcggcgaacggcagcgccagcgcggcaacggtcagacagtcggctcggcgcttcgcgaaggtcgacagcggcaacgattgcatgaagtgcgatgcatgcaggtgcgccgcctgcaaatcgcgatacgtcgtcgccgcgatcagcgcgatgacggcctgcgcgatcagcgtaagcggaacggcgcggtggtcgaaccccagagcgcaagcaggaagcatgtcgaggcggtgaccgcacccatcatcaggcagtgtccggcggtgctcgcggcgcgatcccgcaggatgccgatctgcagcctcgcgatgggcggcagcccgttccggacacggacgcggatcgcatctacgatgcgacgcgggaacgccccggcatttccgaacgggtggcccgcgcaggggccgtatgcgcaatcgtgaaagcagcgagcaacaatgccacggtcagccacgcgggacgtaacgccccctcggcgtgaaagccgccaattaggaagacattggcaacgatcaacgcgattgcattgcgcaggttgcgcgacagcgcggtcaattgccatccgagcgtgatcaggaacaggtcgagaacgaacaggtagttgatcgccttttgcggcaggaaggcgagcgcgatggcggcggcgagcacgggcagcagcagcggcgtactcgcgacgatcacgacgatcgtgtcgatggcgcgacggcggccgctggagacgggcaaggacgcgaggaaggtgacgaacggcccccggtgatggcacgacgctgcgccagcacccacaggatgcccacggcttcgagcaggtgcacccacgcgaaccgccattcgatgccatgcgacggtgccagcgccgcgagtaccggcgcacccagaatgcgcgtctgcgaaaacaccggcatcgccggcagcaacagcatggccagcaggagcagcgcctgccaatgcctgcgcagcaggtttgacgtcgcgagtgcgtaccacctcagtcggcaagacaacatcgcttccagctcccattcaccgagcaaacgaacccggcatcctgccacggtggtcgccgcggcacaaccatccccgcctttggcggccggggcggcacgcacgagatcactgtgccgcatgagaaaccgatgctgcgaatcgccgcgtcggcgggcgggtcacggtggcacgaggcatccgtcagcgtagcggattcatgcgcacgacgccgacgcggatcgttcgacaggtgccggacaggtgcgcggcaagtcgagacacgcgcgtcatacggctcgggtatgctggacgaatgccgggcggatgagcaggcagcaccgcaacacggcacaccacaccacatgcgatcgcatcgcaatcaccggccgcaccgggccgatttcaactcaggaacagggattcgacatggcggaactggacaacgagctgtatgagcggatcggcgcgctgagcgacgcgggcgatgcgttgatggaagacggcgactacgaaggcgcactggagaaatttcgggcaggattcgacctgcttcccgaaccaaagaccaactgggaggccggaacgtggttgatggccgcgatcggcgacgcgaatttccttcaagcggactacgctgccgggtgcgacaatctcggccaggcgatgcacttccccaacgcgatcggcaacccgttcctgcacctgcggctcggccagtgccagttcgaactgggcaatctcgaccgcgcggccgacgaactgatgcgcgcatacatggcgggcgggccggagctgttcgaggacgaggatgccaggtacttgcgattccttgccacgcgtgcggaaggcatcgagacgccctgacgcgcgccgtgcgtgccggctggcattgcgtgcaggctttggcggctgtgccgcgccgcgatgccgggcgttttctccacatgtgcacgacctgcccatgaacctgacctttccctcgccgcccaatccgatgccgaaacgctggtcgccattcgcatcgccgcgatgcgcgacagcctcgagcgtatcggccgcttcgatccgcggcgtgcgcgcgagcgctttctcgcgtcgttcgacccggcgttatgccgcttcatcgaagccgatggcgtgaacgcgggtttcttcgtggttcggccgcaggaagatcactggttgctcgaccatctgtacatcgtgcccgcgcaccagggaaagggcatcggcgcggccgtgctgcaacggatctttgccgaggcggacgcgcagcgcgtgcccgtgcgtgtcggcgcactgcgcggcagcgattcgaaccgtttctatgcgcggcacggcttcatgcaggccgacgaagcggagtgggacatctattacgtgcgcgaaccgggttcggcgacggcgtagatcgcacatgcccgcgcgtcgtgacgacgcatgcgggtgtgatccaggtgagcgcatcagcgttttcccggatatcgaatgcgcggcgcatgccgatgatgcagagagaatataactacatgatccgaggccaatcatgacgacatctgcaacaaacggaccgaatgcggtatcgcctgaaacgaccggggcggcagcgacatccgacgacgcggatggcgtgccgtcgatcctgctggtcgacgacgagccgagcgtgctgtcggcgctccggcgcgtgttccggcccgccggctacgagatcctgaccgcggaaagcggcgaggccgccctcgaggtgctggcgtcgaccgaagtcgacctgatcgtgtccgacatgcggatgccgggcatgagcggcgcggagttcctggcccgtgcccgggcgctctacccggacacgatgcgcatcctgctgaccggttatgcggagatcgcgtcggtcatgcaggccgtcaacgagggcggcgtctatcgttacctgaacaagccgtgggacgatcacgacctgctgctgaccatcgaacaggcgctcgagcagcgccgtttgcggcacgaggcggcgcggctcgccgcgctgacggaagcgcagaacgaagcgctgcgccgtttcaacacggaactcgaaacgcaggttcgcgcgcgcaccgaggaactcgggcagaccgtgatgttcctcgaagccgcgcagcgcgatctgaaaagcagcttcaccgcgatggtccaggtgtgcgcgagcatgatcgagatgcgctgcgggtcggccagcggtcacgcgatgcgggtcggcgagattgcgcggcggctcgcgctggcctccgatgagcgagctgcatgcgcaggacgtctacttcgcggggctgctgcatggcatcggcaagctgtcgctgccggacgaattgctgcacaagccgctcacgcggatgacggcggaagagcacggcctgttccagcagcatccgctgcgcgcgcagatggtgctgacgccggtcgcgcaattgcacaaggtcgcgtcgatcgtgctgcaccagtacgagcgcttcaacgggcgcggcacgccggacgggctggccggcgactcgatcccgccgggctcgcggatcgtcgcgatcgcgcgcgatttcgaagggctgcgcaatggtgacatcggtgcgccgcattcggtcgagcaggcgctcgacgcaatgcgttcgcaggccggcgtgcgttacgacccgcgcatcgtcgaaaacctggccgaactgatgcgggacccggcaagcctcggcatcgcggcgtccgtcgcggagatcaagtcggcgcagctgcgcgaggatgcagctcgccgacgatctgcgcacgcatcgcggcgtgctgctgatgaccaagggcagcgtgatgtccgcacaccagatcgagctcgtgcgccgcttcgagacacgcgaggggacggcgttcgacatcctcgtgctggccggccaggcggcgaagccggcgcagggcgtgccgaatgccggcgcggcgcctgcctgagcccggacgcgcggcctgacggccgcggtgcacacgcgcgccgcggcaacgcactcacctcgattcgggcgctcgatcatgcacggcacctacaatcttccgctcgtcctgctgtcggtcgcgatcgcgacgctggcctcctatacgacactcgacctcgccgccttcatttcgctgctcgacaacccgaagctcaggcgcatgtggctgggcggtggcgcggcggcgatggggacgggcatctggtcgatgcatttcgtcggcatgctcgcgttctcactgccgattccgctcggctacgcgttgccggatacgggcgcgtcgctggcgattgccgtgctcgtgtcgtactttgcgctgtatgtcgtcacgcgcgcgcggctgggctggcggcggctgctcgcgggcggcgtgctgatgggcggcgggattgccggcatgcattacgcggggatggccgcgatgcgcatggcgcccgggattcgctacgatgccgtgctgttcgccgcgtcgatcggcatcgcggtgatcgcgtcgaccgccgcgctgtggatcgcgcaggcgctgcgtgcgcggcaggcgcgccatgcgaccgcccagcgcgtcggcgcggccgtcgtcatgggcgtcgcgattaccggcatgcactacacggcgatggcggccgcgcatttcgcgccggacgcgcgatgcggggccgcgaacggagtcgacacgccgtggctcgcgacgaccgtcacgctgtttacgacgggaaccctggtcgtcacgctgttgctcagccgattcgatgcgcgcacaaccttcctgcgcgggatgaccgatacgctcgagcggctcgtgcgcttgcgcaccgtcgaactggaacgcgcgctgcaccgatacgaacagacgacggcgatgctgcaacgtacccgcgagaacatggcgaccgagatcgacgaacgcaaggccgcgcaggcacggctcgaacaggagaaggaggagcagcggcgcctgttgcatgcgctcgaggaaacccacgtgcagctgctgcagtcggaaaagctcgcgtcgatcggtcagctcgcggccggtgtcgcgcacgagatcaacaatccgatcgggttcgtcagcgcgaacctcaatacgttgaagacgtgggtgcgcagcctgctcgacgtgatcgccgcgcatgaagccgcgctgccgcagctcgacccggccgcgcgcgatgcgctgacggcactgggccgctcggccgacctcgactacgtgcgcggcgagatcgcgacgctgatcgacgagtcgatcgacggcgcgctgcgcgtgcggcgcatcgtgcaggacctgcgcgatttctcgcgcccggccagcgacgagtggagcgtggtcgatcttcgcgcagggctggaaagcacgctcaacgtcgtccacaacgaactcaagtacaaggccgagatcgtgcgcgactacggcgacgtgccgcaggtcgaatgcctgccgtcgcagttgaaccaggtcttcatgaacctgctggtgaacgcggcgcaagcgattcccgagcgcggcgtgatcacgatccgcacgtcgagcgacggcgagcaggtgtcgatcgcgatcagcgacaccggcacgggcatgacgcccgatgtcgtccggcggatcttcgatccgttcttcacgacgaagccggtcgggcagggcacggggctcggcttgtcggtgtcgcacgggatcgtcgagcgccatcgcggcaccatcgacgtgacgagcgaacccgggcgcggcacgacgttctgcgttcggctgccgatccggcgggccggcggaaacgcgaacgaaagcgtgaacgagactgcggccgtggcggaggttagcgccggtccagcagcgtatcgctcaggacgctgaacgccgcgcccggcagctcgtgcaaatgctccaccacgctgctgaccggatagaacgcttcgaccgaatcgtcgagaatcccgacgccgatcagttcgacgcgccgctcgcgcagcgcatcgacgcgtgcgcgcaggtcggtgcgcaggatcgccgggttgccgtcgccggttgccggataaccgtccgacagcaccatcaggatccgccgccgtgcacgctgcgccagcagccgttcggcggcccagctcaacgcctcgccgtcgggattctcgtggccgcattcgatgcacgcgaggccgctcgggttgtcggaatcgaagcgcttgtagacgcgcaggtcgagccgttcgacgaagcggttatagccgaacgtgtcgcggccggcgtcgatccagcgctggtagtgcgcgcgcatcgcggcgtcttcgacggagctgtagccgagcgcctcacacgcgaagccgagctgcatcagcgcatcgcacagcgccgccgcgcacaggcgggcgagctcgatcttcctgccggccatcgacccgctgcaatcgatcagcaggccgacggccgcgtcgcgcccgggcgcggcgcgccggacacggaacggcgtgcggtagccgggcgacgtgacgaggcgggcgagcgccatccggtcgagttcgccgcgctcctgttcgcgcttccagcgcgtctgttcgtccactttcaacgcgcgttcgagtcgcagcttgagcggctcggtctgcgcgcgggccgcgcttcgcaggcggtgccagcgcgccgcgtcgcccttgccggtgaagtccgtcaccgtgtcgaatgcggtggtcagcgggaccgacaacagcggccgatggtccgcggacaggcggatcgtgccgggtgtcgcatcgcctggcgtcggtgatgccgtggacgattccgtgtcggcgatcgcgcccgcgcccgattcggccgaaaccggcgcacgtgcatcgtccggcgcgcccggtccgtccgattcgaattcggcggcgatgctgtcgctgtcgatcgtgctgcccggatcggccgtgaacatcatgttgttcgcaccggccgaggccagcgcgcggacgcgctcgacgatccgttgcgcggcgcggatgctgtcggccgtcgaagtcgcggcacgtgcttcgtcgacgagatcgtccgacgcggcgagcgtcgcgtcgagcgacgggatgcgctcgatcgtagatggcggttcgtcccacagcgcgcgctcgatgcgccatacgagcttgtcgcgccacgccatccgtggccaacgtcgaagcgtatcggcggccgacgccacccgcatttgccgcaggaacgtcatcgcgccgggatagcgcgcaacgaggcggccggccgcgcgccggtcgtcgatcgcctgcgcaatcgcgcgcaacgcgggcgacgccagcgcggcaacgtcatcgatcgcgccgaagcggacacgcgccgcgtggaggtcgacgaggccgacgatcgcgtcgtcgtcgacgtcgctcgcgagcagcgtgtcgggcagcaccagcaggtcgcgctgcgcgagcgggccgtggcgcgcgaaccgtacctcgatgccgtgtcgttgcgcgagcgtgcgggccagccgggtcaggtggagcgagcgcgcatcgtcgtcccggtccatcgcgttaggccccgacgtcgatgtagtggcgaatgatgctgcggatcaggtcggcgtcttccgcgccgaccttcgcatagatcgtcgggccggcggccgcttcgggatcgccggtgcgcagcatcaggtcggcccagtcgatcaggcgccgcgtcgagaacgcgctggccagatcctcgcggacgaacgcggcgcggcagtccgccgcgatcgccgcgagcgtgccggccatcgcctcggtcatggccgcgccgaacgtgcgctgcagcacgcgcgcctcgtcggacggcggcaggtagtcgaggcggtacacgcgccagcggtcgagaaacgcctcgttcatcacgttggcgccctggtaaagatggcggaactgccccatcgcgcccgccgcgttggcggtcgcgaacagccggaatgacggatgcgggacgacgatctcgttgcctttctccttgagcagcaggcgtccggccggttcgagcacggcggtgagcaccgcgaggatggccggttccgcgaagtcgatctcgtcgacgatgagccacagcccttcgcgcatcgcggtcggcagcacgccgtcgacccagcgggtctcgccgcccttgacggtccagaacccgacgaagtcgccgaccgtcgtttgcccgttcatgttcgagcgcagcacgccgtggccggccagcgcggcggcctgttcgatcaggctcgtcttgccggtgccggtgtggccgatcaacaggatgcgccggttctcgacgatgtcttccagcacgtccgtcgcgcgcgcggtgaacaggtaggcggggttccggggcggcacgagcggcccgcccgggccgcgcggcatcggcacgccgcccacctgcacgacgtgcgccgcatcgccggtggccgccggtcgcgatgcgtgcgcgtgtcggaggtcctgcatgaaccggtcgcgatgcgcgggggccgcatggtcgcccgtttcgcgccggacgaaaccttcctggatccacttgtgcagcttcgcatcgaggttgtccgcgtcgacgaccgtatcgaccgacgtgctgccgtcgggacgatgatgctggatgcggtacatgtgtgcgcgttcggagcggctgacaatccattgcccggcggacgggtccgccagttgccgatagacgccgagtaccgacggggcggagggagtggggtcagcgggtgcgttcatggtggcgagcgagagtgggcggccggcgcttcatgccttcgatgcgtcgcgacgattgtatatttttgccgcgaagggcgacattcgcgcgggaatcgtttcgtttcgatgcggcgcgtcggcctgccgtcatcacgtgatgggcaggtgtaatgcgccgcagcatgatctttcggcaccctcgcgacggaatcgaaccgcttttaccgtgccgatccgtctgcaacgccgcgacgcgttgcagtccgtcggcaacctccatgcgcgtcatcgtcgctcgacacctcgcctgacaccgacctccggggcgtgcgacgaagccaacccgtcacgttggatcgtgggccgtcacgccttgatcaacggggtggattttcagtaccgtagcaggcttgattgccaggctcccatcgcgcctcccgggtagcccggcgtgacatccaaccatgcgccggtcgtcgactccggcgaaggagtgttgaacgtgacggtgacaggaacggacgagcgggtgatccgacgtgccagcgcgctggatgcgccggccgtgctggagatcttcgatgaagtgattgcgtggttcgtcgacatcggcaacgacgggcaatgggggcgcgagccctggtcgacgcaaccgaagcggattgcgctcgtgacggaagcctgtgcgctgcccgacgcgtgggtggcggaatcgcccgacggccgcatcctgggcgccttgatcctgggcgaatcgatgccctacgtgccgcccgcgaccgagccggaaatctacgtgagggtgctggttgcgtcgcgcgatgcgcgggcgcgtggtgtcggccggcggctcatggcctttgcggatgagcgcgcccgggctgccggggtgcagcgcttgcgggtggattgttatgggggcggaaccggcgcgctggtgcgcttctacgagtcctgcgggtatgagcggctgtcgaccttcgacgtcgacgggtggccggggcagttgttggggcgcaatctgtgacggtgccggtcaggccggcacggcgcctgtcgagtcgggcgcttgtgccggccgttccgtcagccggaaacggccggaggtgcgacagacgcccggtgggccgacgagccgggatgcgcgggcgtctcgtgcacatcgtgcgcaaccggcagcgcaacccgcacataaagaaacgcccgccgctcgcggtcgggcaacacctgcggcccgtagctgatcgtgaccgtgccgtcgcggatctcgcccgcctgcgcgaaacgccaggcgccggggtcgctgtcgagcaggaattcggcgcgcgcatacgcgagcggttcgaaccgctcgggaatcgcgaccgggcgcccatcgagcttgtcgagcaacgcttcggccacgtcgaagccgtagccgtcgcgcacgatgtcgcagatgaagctgccggcgatgcgcggattgagttcgatcacgtgcggcacgccgtcgtgcacgatgcagtcgaggtgtaccggccccacgtcagcccggcggccgccgttgcgcgcgtaccgacgtcgatcagcgcgcgcagcgtcggcgtgtcgagatcgagttcggacgtatagccgcgttcgagaaagccggcgccatgccgcttcagcttgcgcatcgcgccgacatagcgcccgtcgaaatactcgacgcagtattcgctgccgcccaggaattcctcgatcacgatgcgctcggtcgcaagcgcctgtgtatcggctcgagcggcggctcgagcggcggcgagcgcgtcgagttgagcgcgcacgtcggcgatgtcctcgcagcgccgcacgccgtcgctcgccgagccttccgacggcttgacgacgaccgggaaacgcagcggagcggcggcggctgcgagtgccgccggcgcggccagcgtgcccgtgacgaattgcgcggccgggatgccgtgcgcggcgaggagtgccttctggttcgacttcgacaccgcgtgcgcgacgtggcgcgcatcggggccgggcaggccgagcgcgtaggcgaccgatgcggcggtgcgcgcgtaggtgtcgtgcgcagtcgtcacgcgcaacgtgtcgatctcgtccggatagcgcgcgcgcagccagccggcgagcagtgcggcatcgggttcgagattgaccgtctcgacgccgtccggaaagacgccgtccagactgtgaccgggcgcggtgatgacggtcacggccgcctggcgggcgagcgcgccgcgcacgagcgcgaggctgctgccggtggcgcgtgcgccgatcacgatgagtcgcttcatgctggatccttgatcggtgaagagggggcattgcgtgccggtcaacgtgcgcgccggcgcaggcgctgtgcctcgaggcgcggcagcagatgctggacgacgcgcgggagcgtgtagatcggcagctgtgcgcacgtgaacacgagcgccatggtgggcgtcgcggcgagcccgagcgcggcccacatcaagccgacgttgcgattggcgacgatcagcgcgacattgagccgtgtgcggacgtcgccgggcgtgagcccgtacgcgatgatctggaagcccgcgttgacggcgaacgcgagtgtgatggccgtcaacgcgcggtgcggcgcgtcgatgatcgattgctgcatgccggccatcgtgccgagcgcgaacaccagcagcgcggcgacgacggtcgcatcgatcggcgtcgcatagcggtcgagccgggaccccgcgaaccgccgcacgagcagcgcaacgccctcggcgctgccgatcagcagcgcgagccgcaacgcgagattcaacggcgagatcgacacggccgcatcgtggctgaaccaggccgtcagcagcggcgcggtgagcgggacgaacaccatcgacgcgagagtcgcgacgagcgcgacgctggcgtcgagcgacagcatccgcgcgatcgtcgacgtgccgctcgacggcggcgcgcagtacgcgatcacgagcgcgaccacccagtcgtacggcatgccggcgagccgcgcggcgatgccgagcgcgacagggcacgcgatcatcgtcgcggcgggcagcagcagcgacacggccggccgccgcgcgaccgcgcgcacggcgctcggctcgacgcgcagcagcgtgccgagcacgaacaggaacacggtgacgggcatcagcggccgcgcgaggtccgcgagcggcggcaccagcagcccgaggccgacgccgcccgcgagcaccgtcgggccgcgccgcaccagcgcggcaatcagcgtgcgcacgggggcgcctcgggccggtggtgaacggcggcgaagccggggcaggcggcggatggcatgcggtttcctcgaaaggggcgggccggtacgggatatccgtcaggctattcctgattattggcgaagtaaaatgatataaactgcatcggtaacaagagatagtgatatgaacattcctctgctcgaaaccttccgggccgtcgttcaggaaggcagcgcgctgcgcgcggccgaacggctcggctgcacgcagtcgaacgtcaccgcgcgcctgcgccagctcgaggagtcgctcgacgcgccgctgttcgaccggcacggcaagcggctggtgctgaacgacgcggggcgccggctgattccgtattgcgaccgcatcctgcgcctcgtcgacgaagcgacgcaggtggtgcgcgagacgccggtcgcgcgcagcttccggctcggttcgatggaaagcacggcggccacgcggctgccggcgctcgccgccgcgttgaaggcgcacgatccggcgctcggcctcacggtgcagatcggcagcgagccggatctggccgacgcgctgctgcgcggccggatcgacgccgcactgaccgcgcgcgcggtcgtccggcccgggttgcgctacgagccggcgttcgccgaggagatggtgctggtgagcgcggccagcgtcacgcggcggcaggtactggccgacaacacggtacggctgctcgcgtttcacgacggctgcccgtatcgcgcggtcgcggagcactggctgaaggcgcgcggcatcgcgatcgggtcggtggcgtcgttcggcacgttcggcgcgatcctcggctgcgtggcagccggcatgggcgtcgcgatcctgccgaagcggatcacgaccgagcacgtggcgcgcaaggagctgcgcacgcacgcgttcgacgatctcgacgacgtgacgacctatctcgtcacgcccgaggaagccccgcgctgcccgagctcgacgcattgcgcgcggtgctcggccggcaggcgggcgcgctgctcgcgcgttagcggagtacaactcaagcgcaccgcaccgcatgcgcggcgccgatcgcgccacgcggagacactaggtcgactcgaccgcccgttcgtccgcgaagaaatcggcctcgatctcgcggatgcgccggcaatcctcgagcaggcgctcgaacgtcgggctgtagaggccgaccgtgccgagcgccgtctgcaggtcggtcgtcacgcgcagcgtgtcgcccaccttggcccattgcttgagcccgacgaacgacggcagcgcctggatcgcctgccaggtgaagtcctgccggagcacgccgttgcgcgacgacagcagcagcacgtgcccgcagtaaccgcggaaatccgtcgccgcggcggcttcgccgaacagccgctccggatgcagcacggcctcgacggcggccgatacatggttctcaccgctgaccgcgctcgtcagccgcggatcgaggctgccgtgcagccgcgcgttcagctcgacgatcgtcgggccgtcggccgtatcgaacagttcgagatgggtcggcccgaagcggacttccagcgcgtcgagcacgtcggccgcgtagtcgagcagcggcgcgtaacgcgggtcggcgtgattcagcaccagcatcttgtcgagccgcggtgcatgcgtgcggtcgcggtgcacttcccacaggctgaccacccgatggcggccttcgaaggacaccgaatcgacgatgtattcctgcccctccgaatagctctggatcacgatgtcgtcgttcggctggttgtagagcgaacgggtggcgagcacgtcgcgtgcggcggcctcgacctggtcgagtgtccggcagatcttcacgcctgccacgcccgcgctgcgggccggcttcaccacgagcggcagcctgccgtgcgcgcgtgcccaatcgagcgtggcgtcgaccgacgtgctgtggaagtgggccggtgcgcgcaggccggcctggcggatgcgctcgttcatcgcgtacttgtcgcggcgcgcggccgaggtcgcgagcggattgcggtacggcacgtcgagccgctcggccagcgtgtcggccagttcgagcgccgcgtcgaggccgtgcagtaccgcgccgatccgcaggtcggccagctgcgcgagcgttgcgtcgaggtcgccgcgatgctggacctggcggatgtagtcggacgggacgaactggttccggtagatctccggcaggtcggggtcgctgatcacgtgcgcgcaacggatgccgtaggcgcgaaacgcgggcgccagataggcggctgtcgacgcgccgtcgacgatcaggacggtatcgatgaaacgatgcggcatggattcctcgctgggctgtgggatcggttgaaggaggcggacggtgcgggatcaggcccgcgtgccgggttcgggcgcatcgccgggccagcgtgcggccagcacgatgcagacggccacgagcacggccgcgacggcgaatgcgtgtgccgcgccggccacgatcgcggcgccttggcccgcgaccagcgcgccgagcgccgcgacgccgacggcagcgcccacctggcgcgcggtattgaggatcgccgacgcggtggccgagcggccggcctcgacgctgccgagcagcgtcgacgtcagcgcgggaatcgcgatgccaccgccgatcgccattgccgcgagccccggcgcgagcagcgcatacggggtatgcgcaccgagggtccgccacagccacacgtagcccgcgagcgacaccgcgagcccgacgatgacggtcgcgcggaatccatggcgcacggcgaggcgcgcgctcgcgatgttggcgagcatgatgatcgtgagcggtgcgagcgcgagccccgattcggtcgcggtgaagccgcgcgcattctggaaatagaggctcagcgagaaaatcagcccgtagaacgcggcattcgtgatcgcgccgatcgcgagcacgcccggcacgcgcgcgatccggaagaacgcgagctgcagcatcggcgcggccacgcggcgctcgatcgcgacgaacagcgcgccgagcgcgaccgacgcggccagcgcaccggccgcatacgggtcgcccggcccctgcgcgccggcccggatgatcccgcccgtcagcagcgcgagcacgagcaccgcgacgagctggccggccggatcgaacagccgcgtgcgtgcggcggccgaatcccgcacatggcgcaccgtgacccacaacccggccgcgcagatcggcagattgatgaagaagatcgcacgccagccgagcgaatcgatcagcagcccgccgagcgtcggcccggccgcgctgatcgcgccgccggtcgcgctccaccacgcgacggcccttacgcgcgcggcggcatcgttcgcgcacgcatgcgtgatgagcgcgagcgacgtgggcaggatcatcgcggcgccgacgccctgcgcgacccgcgcggcgatcagcgcgaccagcgacggcgcgagcgcgcagccgagcgatgccagcaggaacagtgcgaggccgtacgcgaacagccggcggctgccgaagcggtcggccagcgtgccggacgtcagcagcagcgcggcgaacgacagcgtgtacgcatcgacgatccactgcagcccgtggacgctcgatccgaatgaatggccgaggctcggaatcgcgacgttgacgacggtcacgtcgagctgaacgatcgcgaagccgaggcttgcggccgcgacggtcgggaagatcgcgcgcagcgacgtgcgatgcggcggtgcgatggcggccggcgcgccgccgagcgccggagcgcgttcgcttattgcggcctccgtgccgggtggcgcgcaaggcagtacgcgggcagggtcacgtcgtgaccggacgaacggcgcagcaggcggaatcgggtcatcgggcagatttccgtagggcggaggaagggcgccggctgccgatcgacggccggccgcatcgtcgaatccgacagaaaactagcatcgacctgctaacgaatacaaataataaccagcgatttttaaccacctttcgtgttaaggggtggtgcgatcgacgctgcctgacgccgccgggattgctgaacttatatcgaaaatttttgtttgcaatcgacttaatatcatttcgcaatgcaatgacggtctcctagtcttgtcgagcgctgcgccccgaggacggcaacgcgcggcggcagtgccatgccgctcttcgaaccccgatctttatacgagagacctatgacctatctcgcagatgaacgcatcgtcttgacggcagcggagtccggtcacatccggaagacgctcggcgcactggcctacgatccggccggcggcgcgggctacatcagcgcggtgcgcaagctcgcctacaacgcgtttcccgaccggatcgtcgacgcgttcgatcgcgcgaaggcaccgaccgccgacgcgcacggctcgatcgagatcgacaacctgccgatcgacgacgacgtgaagggcagcccgaggttcgaggagaccggccgctcgttcaaggccggcgtgttgagcgagaacgtgctggtcgccctgagcacgctggccggcgaaccgtattcgatcgcgcacgaaggccgcgagctcgtgaacaacctcacgccgcacaaggcgaccgcacgcgactatacgggcctcggctccgaggtcgagctcgatttccatatcgagaacgccgcgcaggcgcacatgccggaaggcgacacgtcgccgttcgcgttgctgcttctcggcgtgcgcagcgaagccggcggcggcccgtacacgcggctcgccgacgcgcgccgcgcgctgcagctgctgtcgccggacgacatcgcgcaactctacggcgagcactacatcatccgcgtgccgtaccggtggcgcggcgccgcgccgacgccgcgcgacaataccgacctgagcgcggtgctgtcggggccgctcgacgcgccgcgcgtgacggtcgcgttctatccggacatggtgctggcagtcaatgcgcgcgcgcaggaggcgctggccaacctgtatcgcgcggtgcgcgaagtgtcgttcggcgtgcaggtacagcccggcaagctggtgctgatcaacaaccatttcacgctgcattcgcgcgaccgtttcgatccgcaatacgacgagaacgaccgggcatttcgctgggtgcagcgcgtgttcgtcgcgcgcagcctctggaacttccgcgcattcacgcccttgcaggcgcgggtcttcgatccgaaggcgctgtatgcgggcgacgtgcacgcgacgcgcccgtcgccggtcgcgcaaccggcgccgcaacgcgcggccgccgccgaactcgaggcaacgcccgcgtgagcgtaccgggaacgccgggaggagacgggcggcgaacgggcggtgagcatcgttcggcgccgcccgcgttcggcacacgcgtcgtcaaacatcaaggaatccggaagacatgagaagaacagcaattcccgcagcacgcatcgttcgcacgctggccgccgtcctgctcggcggcagcgtcgccgcgcaggccgcgacgttcgacctgagccccgagcagccgggccggcagcgcggcaccgtgaacccggcggtcgagcaggcattgccggccggctaccggtttgccgaagcgggcacgttgacgatcggcatcgcgccgaacctgccgccgctcagcacctatgcgaccgatgcgcgaacggtcgtcggcttcgaccccgatctcgcccagctcgtcgccgacagcatcggccgcaagctgaagatcgtgccgctctcgtgggccgactggccgctcgcgctgcagtccggcaaggtcgatgcggtgatctcgaacgtgacggtcaccgaacagcgcaaggagaaattcgacttctcgacctaccggaaggatcagctcggcttctacgtgaagaacggcagccggatcgcgtcgattcgcgagccgaaggacgttgccgggctgcgcgtcgtgaccgattcgggcacgaaccaggaaaagatcctgctcgaatggaaccggcagaacgtcgcgcgcggcctcgcgccggtcgagatccagtactacgcggacgcggcggagcgttgggtcgcgctgcagtcggggcgcgtcgacacgatcttcagcgtgaactcgatgctcgcgtaccaggcatcgctgcgcggcgacgcgaagctgatcggcaccgtgagcggcggctggccgcgcaccgcggacatcgcgatcacgacgcgcaagggcagcggcctcgccgatccgctgacggtcgcgatcaatgcgctgatcgcgaacggcagctaccggaaggtgctcggccgctggagtctcgacgccgaagcgatcgaccggtcgcagaccaatccgccggggctgccgcgcacctgaaccgcccgggtgccgattgccgcgatgctcaggtgatcggccactgcaggatcacgatcccgtcgttgtagtcggcatcggcgccgtcctcggcgccgagccagccgagccagacggtgtcgcccgcggacagcggcgcgagacgcgcatcggtcgcggatttcctgccgttggcgaacgcgtcgatccggatcttgccgcccttcgagttcagcgtgaacagcctgacgccgtcctcgctgttgccggtgaacgacgcggccggttccggcgcatcgtcgatgaagagcctgaggtcctgccggtcggcggcattcgcgtagaagatcgccttgaacgcggtatccggcggcagcgtgaagttgccgttgcgatccgacgacggcttgaaatccggctgtttctcggccggctggccggcgccgatctcgatcgacgtttcccagcggaaatagcccgatacggtgccgtcgcggtcgaacacggcgaaatcggccgtgcacgtggtggcgcccgcggccagcacgtcgctgcgccagtagtggtccttcatcggatggcacggcggatgcagcaggtcgtcggcatcgggtaccggcgcggccgcgtcgcgcacttcggcttcgaacggcgcgacgatgcccgcatccttcaacgcgaaccggacgaacagcacgctcgcctcggcgcgcagcgccagcgcggtctcgcgcaggcgcaactggtcgcccggcgacagcccggcgaagagccggctgtcgttgtggccgagctgcgcggcgtcgccggggctcaccacgtagaggtgccggccgtcgatcacggtcggcgcgtcggggtcccggctcgcctccgggtaggccgacagcagcgtgacggcgtcgacgatcacgagcacatcggaacgaagaccaggcatgagcgcttcctccgcaacaaggggttgatgcgggcagccgccgcgcggccgcccgcctgccgcgatcagttatggatcgagatgaacggatcccacgagaagcagccctggctctggcagttgcgatcgatgatctggaactggaagtggtaagtcacgcggccgaccttcaggcattccgacgaccagtagtagttcgcgaccttctggcaggtcggcacctcgggcttgctggtgttcggcaccgggatcgacgcttccgcgacgcgcggcgtcggcgtcgagatcagttcgttgccgacgttgccgatgaacttgtagaacaccacctggttctcgaagcccagcgacaggctcgtttcacgccagcggatcaggtcgccgacctgcgccttcaggtcgagttcgccgcccgcctgcccggacaccacgttgtcctggttggtgaccatgtacacgtgcttccagtcgatcagcgtcgggttattcggattcttgctgggattcggatatttttgaggatggtttcggtatcgaaagagacgagcacatcggtaacgcgtgacatagaagctcccgtttgaatgaatgggaattattgttgcgcgaattttgtcgcgcagccgccattgccttgtcctgcaaggctcgtcgccgttcgatgcccgtgctggcgagatggcgaaggcagattatcccgttcggttgtttatggaagctgtaaaagtaaacagggtatttaatttgtttcgggcggtaattttaaaatcggaatcaatcggattcatgcgtgacataaatatgccgacattgaatctgttaattgaatggccgattattttcggggcggcggggaggggcgttcaacgataggtccagagccggtgcagcaggaacgtcgtcggtggaatcagcaacgcgatcgcgacgatgctcattgcgcgggacacgtcgagcgcttcggccgcacgcgcgagcagcagggtttcgacgaagccggcgagcgtgaccgcgagaaagcgcaccgcgttgcgcgtgcgcaccgtcgacgaaaagctccacagcgtgttcgcgagatacgagaacgccgtcgcgcagaggaacgcgatcgtgttcgccgtcaccagcgtcgcgtcgaaccgcgcgaacagcgccgccgcgaccagcgtgtggatcgcggtcgagcagaggccggacacaccgaagcgcacgaggcgcgtgcgctcggcatcgagcaggccgatcatggccgtcgccgcgcgtcagcgttcgccgatccgcgcacgggtcggctgcacgcgccggcgtgcgctctggcggcgcgcatcgcgcgcgacccgcagttcgaccaccttgccgtgcgtctggtagcggcggcggatcaggtagacgggccgttgcttcgactcgtcgtagatccgcccgatgtattcgccgacgacaccgatcccgatgagctcgatgccgccgatgaacagcgtgaccgagatcagcgacgcgtagccgagcaccggattgccgaacagcagcgtgcggagaatgatgaacgcgccgtacaggaacgcgagcgcggcgatgccgacgccgatgtaggtccagctgcgcagcggcacggtgctgaagctggtgatgccttccagcgcgaaattccacagcttccagccggaaaatttcgagtgtccggcactacgcgcgtcacgctggtattcgacgatgaccgtccggtagccgacccacgcgaacagccccttcatgaagcgatgccgctcgggcaggctgcgcagcgcgttcacgaccttgcggtccatcagccggaaatcgccgacgttctccggcagtttcacgtccgacagcaggttgtgcacgcgatagtagatcgcggccgccgtgcgcttcgcgaacgaatcgcacgcgcggttgctgcgcttcgcggcgacgacttccgcaccgtcgcgccagtgttcgatcatcaccggaatcaggctcggcgggtcctgcaggtcggcgtcgagcgggatcaccgcgtcgccgagggcttcgtcgagaccggccgtgagcgccgcttccttgccgaagttgcgggtcaggtcgatcacccgcacgcgccgttcgccggcgccgatccggatcagccgctcgagcgtgtcgtcgcggctgccgtcgttcacgcagacgatctcgaaccggatgccgtcgatggacgtcatcaacggcatcacgacgtcgaagaagcgttcgacggcctcgccttcgttatagaacggcacgaccagcgatacgagcggtatatagagtggttcccgcatgatgatttcccctgtgatgtcgcttcaccgatgcacgccgatggtcggtcggccggtgcggcgcaatccgtacgccgggcggtggtgcgttcttgccgaatgggtgaacgcggtgtcggtcgagtggtcgcgtgcgtccggcatcgacggcacgtcgcgccggtcccgggcgatccggctgacgagcagcccgagcgacgccagcgtgacgagcggcatgaactggaacgacagatgcggcacgaccgcgaggcccgcgagcggcatcagccacagcagcgtcagccattcccggtcgaagcgccgccagccgtgcgtccacgcataacgcgcgtaccacgcgatcacgaggccgtaccaggtcaggtcgtagtcgtacagataggggctgacgagcaggcacgcgcacgcgagcgtcgcggcgcgcagcgcgtacgcgcagtcgccgcgccacgcatagacgaccgcgatcgcggcgaccgcggccgacagcagttgaaggccgttggcgacgtaagtgggtaggcctgccatcgtcgcgagcgcgaacaccgacggcatgcgcgcgagcttggcctggccggtgccgacgatcgtgtagacgctgtcgatcacatgcgcgaaggtgatccacgggccgaacccgaacgcgagtgtcgcgagtgcggcgctgcacgcgatcgtcgcggcccacgcggcaagtgcgcgccattggccggcgcacagcagcgcgagcgggaacagcaccgcgagctgcggcttcatcgtcagcaagccgaagcagatcccggcgtgcacggggcgacgggccagcgcgagcaggccagcaccggcgagcaacgcggtgaagaggctggtctgcccgacgatcaccgtgaggaacgcgccgggaatgcgaacgcgcacaaccatgcgtcatctcgctgcacgatcgcgcggatcgttgccgaaaacagcgcataggtgagcccgagccacagcacgagcgccagcgtgtacggcagccagccgagcggcagcacgagcagcagcatcgagggcgggtagagccacggcagcgtgccgtccgcgagcgtcatcgtcgggatcgcgagcttctgcactgcgaacagcgcgggaaaatgccaggcatcggccgcatgcccgtgcgcggcgagccacgcggcgctccagatcggcgagaaatcctgcgacagcggctgcagcgcgccgttgtgcgacaggtacacgcgggtgacgtagatgcagatgaacagcagctcgctcgccagtgcggcgcccgcatagaggcgcacgcgctcgcgattgagccagtgcgggtagcggcgcgggcccgcgatcgggagttccggatgcacgtcggtatccgggtgcgcgtggcgtgcggaaggtgacgatctcatcgtgcgctccgggattcgagcgccgtgcggcgcacgacgatgaacagcaccgcgagcagcacgatcggcccgatctgcggcagcttcatcagtcggttgaacatctcgaagatcggcagcagccacgccagcacgatgatgccctggtcgcccggcagccagcctttgtcgagaccgtgcgcgatcaggcagaagatcgcgatgccgagccacgtcagttcgtaattccacagatacggcgtcgtcagcagcgtggcgacggccagcaccgcgccgcgcaggcgcatgtcgggcgtgcggcgccatacgtcgacggccgcggcgagcgcgagcagcgcgaccgccgcttgcgcgaccagtgcggccgtcaccggcaggcccgcgagccgcaatgcggcgaacggcgtcggcgacgcgagccagtacgacgggagcatgaaatgctgttcgcgcaccgtcgacagtgcctggctcaacccgtgcagcgcaccggggccggccagtgcgatgccggcggccgcgaacagcgcggcggtgatcgcggccgccgcgaaggtgcgccacgcacgtgccgcgatcagcacgacggggaacaccacggccagctgcggcttgattgcgagcagcccgatcagcacgccggcgacgaccgggcgcttgccgagcagatgcagcgcgagcgcggcgaggccggcagtcaggatgctgttctggccgaacagcgcggacatgcacaccgccgaatacgcgaccacgacgatcgccgcggcgtgcggcaccggaagatgcgcgcgcaatcccgacaaccgcgagacggcgaacgcgtagcataaaagactgcccgcgaaaaagaggaaatatgcgggcaggaaaggcacaagggcaaccggagcgatgaacagcaacatcgtcggcggatagagccaggaagcgaccggtgctgcaaatacgtgtcgaattgtgcgagctcggcctgcaggaataaggaggggtcgtaggccgatgcggcatggccttgcaacaccaggtgcgatgcggtccagaagacggagaaatcgacgcccggccggacggcgacattcgacgtgaagccgctggtcacgaagccccagacaaccagcaacgcggcgaagagcatcagcatgatgcagctgtacggaatgatccggtcggctgtcagccactgagcgcggcgtgttgcccgcccgcgcatttcacgattggctgtgtacatgattccccgtatttggtagaggccgcttggtcaatcgcagccgtttgatcttgtggtgcctgcggatcgagtcgctctgaaatggcgttgtccggtgaggtcattgttggagaaaaatggcgcgttgcaaatcacccgctgaatgccgggatttattctggcctaagacgcacgtgaaaaccgcattttcaggtatgagaaatccgaactgcgggctttcgtgtttctgccttgaaacattccgtcgtttcgaccggttccgcgccccggcgatcactcgggacgcgagcgccgtcgagcgtccgggaaaatcccgagtaaaaattttcgatcctttgcgcagcgcggcggcgggcattcaggcgtgaaacgctcgccgggaaacatatatcaattttgaaacatttcgcacactgcaccccgggccgggagagcgggcatcgtcggaacccttgatgcgcctcgatttcgcctcgggtggcctgctctttgcgtaagcgttggcacggcagtcgacgatgtgacgaccgggcggttccggcaaaagacagacggaacccggcaccggaatcacaggcggaaagaagggccggagcgcatcggggaacaagcagctccaggtcgatcaaccgcgcaagccttcgtcgggtgaccaatgagacccggtatcgtcagggcaataaaaagtcggcatggccgcatatggggaataaaaatgaaagaccacagcacatcacggttcgagaaccggattaaaaacatattgcagcttatccgggagtttgtctcccattcatctggattccatgcgtcgaacggcagtcgtgccgttccggtcgatcggatggtccggttcatccggccggtcgcaccgtacacgcctttctcgttcactgcgtcactgatacccattcgcacggacaggggtgcatatccccgctcccgcggctgagcgacgcgtcccgatttttcgagtagtgccggtggtgcccaaccccgacgtcctgaccgacgaagggaatttcatagcagtccgaaaggagaatgctcatgacaagaatcatcgaaaagatcgcgtggttcgtccaggatcaggacggcgtgacggccatcgaatacggcctgatcgctgccctgatcgcgatcggcatcgtcgtcgcgttgacgacggtcggtacggatctgaagaccgtgttcagcacgatcgccgcggatctggactcggcggtagcaggaatctgatggacggtacgacgaacggctcgtccgaatcgttcgtcggcaccacacggcatcaacgacattcctcgacgtatcgatgcacggtcatccgaccagccggcacgcgagggctttgaaagtgaccacccaaggagatcaacatgtccaagttcattcaacaagccagccgtttcgttcgcgatgaagacggcgtgaccgccatcgagtacggcctgatcgccgcactgatcgcagtcggcatcatcctcgcgctgtcgaccatcgggaaggacctcaagaccgtgttcagcacgatcgcggccgacctggactcggcggtggcgggtatctgatggagcatgccgcggacggctcggccggtgcagcgctcgagccgtccccggcgatccgatcaaccgggaaccggagaccatcatgcaagccaggatgcgtgtcgtacgtcgctggatcggcgacgagcagggcgtgacgtcgatcgaatatgcgttgctcggcgcgatgttcgccgtcgcggtgctggggacggtcgtcacgctgaagggttcgcttgccaatgcgtacgaggtgatcgcaacggccgtgacggccgccgtggccaccgcgctggcaatggtttcctgatccaccgattcgactgcgaggttcgccatgctacctgttgcgccgccttacccggttccgttgtgcgtgacgctgctcgcggtcgccgcggccagcacggacatcgcgacccgccgcattccgaaccgtctcgtcctgctcggcctggccggcgcgctggttgcccagtgcctgttgcacggtgtcgcgggggcgcgctcggatggctcgccggtgccgcgaccggcttcggcctgctgttgccgttctacctgttgcgcggaatggcggccggcgacgtgaagctgatgctcgcgatcggcgcctgggtcggcgcggaaatgacgttttacatcgtgctggccaccttcctggccggcgggatcggcgccatcgcctatgcgctgctgcgcgggcggatgcgccagatgtgggcgaacgtgcgcgcgttgatcgcgcggcgctcgccaggcgcgagcgccgaggccaccggcggccccgtcgaaatcgcatcggtcggcacgctgccgtacggcgtggcgatcgcggccggcacgctgggcatgctgttcgcgtcgtgcgcgtagcgcgacggatctgcaacgaggacggaacgatcatgaacacgaatcacaccgaaccgagatgcgacgcacaggtggcacgcctgcccgatccgttgccgtcgcgggaagcgcatacgaagctgggcgcgcagttgccggcggcgccgcgctcgctcgacgataccgggttgagcatgacgttcgtcgccggtctcgtgctgaagtcgacgctgatgctcggccgcccgtcgtacggcgacctggtcgaacggcactgcctgccgctcgccgtgctcgacgacgtcttcgcgttcctggtgcgcgagcatctcgtcgagctcacccatcgcggtgcgaccgatctcgacgtgacgttccgcctgaccgacgcgggccgcgtgctggcgctcgaggaacgggcgcgcagcggctacagcgggcccgcgccggtgacgctcgacgcgtatctcgcgtgcctgaacgcgcattcggtacgcaagctgcacatcagccaggacgaggtgtgggcggcgttcgaaggcatcgtgatcgacacggcggtgctcgatgcggccgcggctgcgctgaacgcgggccgtccgctgctgatctacgggcccgccggcagcggcaagaccttcctcgccgagcggctcggttcgctgatgcggggccgcgtgccggtgccgtacgcgatctgcgcggccggcgaagtgatccagatctacgacccgctcgtgcacgtcgatgcgggaacgtcgtcgggcggccagtcggtcgatcgccgctggcgcctgtgcgaacggccggtcgtgatgtcgggcggcgaactgacgctcgacgagctcgacctgcgtcgcgacgaagtcgccggcttttaccaggcgccgccgcacatgaaggcgaacatgggcatgtacgtcgtcgacgatctcggccgccagcgcgtcgagccgcgcgacctgctcaaccgctggctgcgtccactcgatcgcggcgtcgattacctgacgctcgaatccggcaaccgcttcgtgatgccgttcgacgtctggccggtgttctcgagcaacctcgcgccggagcagttctgcgacgacgcgttcctgcgccggctcggttcgaagcttcacgtcggcgcgatggcgatcgacgactaccgcgccgtgtatgacgcagcctgcgcatcgctggggctcgtatcggcgagcgatgcattcgactacctgctgcatcggctgcacctgccgaccggcaaggcgtttctcgcctgttttccggcggacctgctgcgtctcgtggccgccggcgcgcgttaccgcggcgatccgcccgaggtgacgcacgacgcgctgtacgacgcgtgggtgagctatttcggcgcggcacccgaacgtgacggcgtccatccgccgcccgtcgaacgcggcggacgcaccttcatcaccggttgagccgtttctttcacgattcgtcgaggagcattgccatgaaaaacagtcgagcggtcatgatgctggtcgtcgcgatggtcgcgggtcttgccgcggtcgtgttcgcgtcccactggctggtacagacatccacgagttcggtcacgccggtcgcggtggccaccaccgacctgaacctgggcgaaccgctcgggccgaaccagattcacatggtcagctggccgtcgggcagcgtgccgaccggcgcgttcaccgatacgaaggcgctcgaagggcgcgtcgtgcgcaccagcctcgcacgcggcgagccggtgatcgagacgaagctcgcgccggtcggcacgaagggcgggctgtccgcggtgatcgccgacggcagccgcgcgatcacggtgcgcgtgaacgacgtggtcggcgtcgcgggcttcgcgctgccgggcaactacgtcgacgtgatcgtcaacacgcaggaacagcagggcaagaccgacgggcagagcatctcgaagatcgtgctcgagcacatcctcgtgctcgccgtcgcgcagcaggtgagccgcgacgacacggcgccgaaggtcgtcaacgcggtgacgctggaagtcacgcccgaccaggccgaacggctcgacctcgcgcgcagcgtcggcacgctgtcgctcgtgctgcgcaaccaggtcgaccagaagacgttgaacaccgacggggcgaccaagatgacgctgctcggcaaggagcccgcacccgaagcgcccgcggcgcccgctcgcgtacggacggtacgcgtgcacgtcgcatcgcatgcggcgccggaagcgcggcgcgactgcgtcggcgtgctgacgggcgtgaagggcagcgtcgagtgtttctgaagcagatcaacacagtcacataaacggccgcctgcaacgtgcggcggccctggaagtcgataaccggcacggtgccggtctctcggggatcagacgaaatgaagatcaaaccgcaatgcacggataccggcccgctgcgcacacgcgtcgcacggggcacgatgatggtcgcgatcctctgttcgggatggctgacggtttatggcgcactcgcgcaggaaggcatcgagtcggcggtgctgacgaagggcggcgccagcgcgccgaccgccgtcggcaaggggccgatgcagatgacgatcagcatggcgccggtggcggccgccgcgcccgccgcgtcggcggggccgctgcgcgggccgaattgcgtcggcgccgtgcgcgagtcgaccagcgtcagcgtgccgctcggcaagtcgctgctggtgccgatgccggagccggtccgcaatcggacgatcggcaatccggcggttgcgcaggccacgatggtgtcaccgcagacgctgtacatcctcgggctcgcggtcggcacgaccaacatgatcgtgcagggcaagagcggcgcatgccgcgtgatcgacgtcgcggtcggcgcggatgccggcggcctgcaggcgtcgctgctgcagctgatgccgaacgagcgcgacatccgcgtgacgaccgcggccggcacgatcgtgctgtcgggcaccgtgtcgagctcgcaggccgcgcagcaggccgtgcagatcgcgcgcgcttacggggacagcgccggtgacccggccgcgggcggcaagcaaagcggcggcggcgtgctgaacatgctggccgtcacgtcgccgcagcaggtgatgctcgaggtgaaggtggccgaggtgtcgaagacgctgatcaaccagatgggcagcgcgctcaacatccagggcgggttcggttcgtggagcggggcgctggtcagcaacctgctcgcgggcgtcgcaagcggcgtcgcgttcagcaaggcgaacaacaagccgttcaacctcgcggccgacgcacagaacaccgacaacctggtcaagatcctcgcggagccgaatctcgtgacgatcagcggccaggaagcgacgttcctcgccggcggcaagatcttcatcccgattccgcagagcagcggcaacggcacgtcgtcgatcacgctgcaggaagaggaattcggcgtcgcgctgaagttcacgccgacggtgctcgccaacggccggatcagcctgaaggtggcgccggaagtgtcggagctgtcgcagacgggcgtcacgctgagtgccaccaacatcggcggcacgtcgatcctgccgctgatcacgacgcggcgcgcatcgacgacggtgcagatgagcgacggcgaatcgttcgcgatcggcgggctgatcaaggacaacgtgacgggcgcgctgaaggcgctcccgggtgtgggcgaagtgccggtgctcggcgcgctgttccgcagcacgtcgttccagcaggatcgcaccgagctgatcttcctgatcacgccgcacctggtgaagccgctgcagaccgccgacgtgccgctgccgaccgacagcttctcgaagccgaacgaagtcgacgtgtacgcgacgggcaacatggaaggccgcggcggtgtgcgcaagcccggcgcacaaccggcgaacggcgcggcagctgccccgcaggcaccggctcaggcaccggctcaggcaccggcaccggcgccgcaaccggatgccccggccgccgcggccgccgcgctgcccgcaccgcgtgtgccgcaaggcgcggacgcgcagccgccggtaccggccgaaccgcagaagacgcccgcgccggtggccgctgccgcgccgcggcccgacgcggccgatgcggcgaacgcagccaacgcagcccgtgtcgcgcgcattgaagccaccgccgcgcgtcttgccgcggccggcccggccacaccggcccagccgacgcaccggctcccggcggccgcccacgcgcaggtcgcacgctcggaatccgagtccaccgatcgttgatgccatccaaggggacactcatgaaatccgcctacttcgtattcgtgcgccgtgcggcgctcgccgcaccgctcgccttcgcgcttgccggctgcatgtcgtcgaccccggtgtgggacacccgcttcggcgaatcggtccgcgccgtgacgcaggcccagatcatcgacccgcatgccgccgaacacgtggccgcgacgacggtggtcgacggcggcgcggcagcgtcggcgctcgacaactacgaaaagtcgttcaagcaggtcgatccgcccgccaatgcgttcgtgatcggcatcggcaaggccacccagtaacgacggcacgctcaggagaacgccatgaacagcgcagcccgctatccgaaagtcatgcgtcgcagcctgcatcgccagcgcggtgccgtcgcgatcatcgtcggtctcgcactggcggtgatgatcgggttcgtcggtctcgcgctggatctcggcaagctgtacgtcacgcgcagcgaactgcagaacagcgccgatgcatgcgcgctgtcggctgcgcgtgacctgacttcagccatcagcctgtcggtggccgaggcggacggtatcgccgccggccacctgaatttcgtgtttttccagaacaagtcggtgcagatgtcgacgaacgcgaacgtgacgttcagcgattcgctgtccaacccgttcctgacgaagagcgcggtcacgacgccggctaacgtcaagtacgtgcagtgcaccgcgacgctgagcaacatcgcgcactggttcatcgaggtgctgaacgtgctgcccggcacgaagctcgcgaacgcggcggaggtgtcggccagcgcgatcgcgactgtcggcggcgggcagacgacctgcgcgattccggtgttcgtgtgccgcgcggcgggcgcacctgcgtacaaggtcggcgactggatcacgtcgccgtccgggtcgtcgtcgacctacggccccggcagcttcggctgggccgcgctcgacggctcgacgaacgaaaccaccctggccggcgagctgtcgggcaacacctgcaacatcacgagcccgccggacctcagcaccacgggcctgaagtccgcgtcgctgcgtgcctggaatacgcgcttcggcatctatacgaacggagcgaacgggtcgagcggccagcccgacttcaccggctacgcgtacgtcggccctaactacgggccgcccggaacggccggcatcaagggcgacgcgtacacgcagttcgtcgccgaccgcgcgagcttcaagccctaccagggcgacggcgcgccgccgtcaggtagcgggatttcgaccaacggcaccgcgacggcgagcaattaccagaccttcggcggcgaccgccgcgttgcgctcgcgccggagggcgactgctcgacgctgaacggcaatagcggcaggtgcacgtcacgcaatgggattgcgtgctgatgctcgatccgcttccgttcagcgccggcagcggcgccgtcgtggcgcacctcgaatacctcggctcgtcggtctccggcaacaacccgtgcgcgacgcacggcttgcccggcagcggcagcgcgtccgggacccaggttccgatgctcgttcaatagcggagagatgatcatgaagaagccgccgtttcaccgttcgcgcacccgtggcgtcgccgccgtcgagttcgcgctcgtgctggtaccgatgatcatgctcgcgaccggcgtggccgagttcggccgcgcgatctaccagtacgagacgctgaccaaggcgacgcgcaatgcggcgcgctacctgtcggtctggctgccgaccgacagcgcgtacccggtgtcgcaggcgcagtgcctcgtcgtctacggcagcacgacgtgcggctcgtcgggcaccgagctggtgcctgggctcacgacgtcgatggtgacgatctgcgacgcgcagcgcacgaccggctgcagcgacacgtccgatccgtcgcagttcgcgaacctgccgacctacgactcgaacaacaacacggcaagcgggacggcgacgggcgcgatcaacgtcgtcgaagtgaagatctcgggctacaagtacaagccgattcccgcctacccgtggctgccgtcgatcaccttcaacaacatcgtcaccgtgatgaggcaagtgtcatgaacgcacgccatgcccccagtcacgccgccgcgcccagcgcggctcgacgatcgtcgagttcgcgctgatcgcgtcggtcctgatcatgctgctgatcggcatcttcgaattcggccgcgtgctgttctactggaacaccgcgagcgaagccgtgcgtctcggcgcgcgcacggcggtggtgtgcgacgtgaacgccgccggcgtcgcgaagcgcgtgagggcgctgctgccgctgctgtcgaacgcgaacgtgtcggtgaactactcgccggcgagctgcgacgtgaattcgtgcgcgttcgtgaccgtcagcgtcacgaacgtcacggtcaagacgatgatcccgttcgtgaatgtctcggtcaggatgccggctttcgcgacgacgctgccgcgcgaaagcctgacttccgcgaccggcggcgcaaactgcaattgatcgaacaggcgaggcacacgacatgatcaacatcctcgtagcttccgacgataccgcgcgactcacgcagatcgcgcgcctcgtggccgactgcggacgttatcgcgccacgcgcgcgaccggtcgcccgtcgcagatcgaacatcgcaccgacgggctcgacgcgttcgacatcctgctggtcgacggcacgtcgctcgagccgtccgaactgtcggcgatcgagcgcatctgccgcgcgcacgcgggcctgacctgcattctcgtgacggcggacacgtcgcagcacatgctgctcgacgcgatgcgcgcgggcgcgcgggacgtgctgcagtggccgctcgatccacaggcgctcggcaatgcgctcgagcgcgcggccgcgcaaagcacgcggcgcgacaccgacgatacgcggatcgtgtcgttcatgtcgtgcaagggcggggccggcacgagcttcgtggccagcaacatcgcattcgagatcgcggaaggcttcaagcgccgcgtgctgctgatcgacctgaaccagcagttcgccgatgcggcgttcctcgtcagcgatgaaaccccgccgtcgacgctgccgcaactgtgcacgcagatcgagcggctcgacagcgcattcctcgacgcgagcgtcgcgcacgtgacggagaacttccacgtgctcgcgggcgcaggcgacccggtcaaggccgccgagatgcgcgaggacgcgctcgaatggatcctgggtgttgccgcgccgcgctacgacttcgtgatcttcgacgtcggtgtctgcatcaatccgctgtcgatggtcgcgctggatcgcagcgaccagatccagctggtgctgcagcctgcgatgccgcacgtgcgcgcgggccgccggctgctggagatcctcgtgtcgctcggttactcgaccgaccagttgcgtctgatcgtgaaccgcgcgacgcgcgcgagcgaccgtacccgcaccgcgctcgaggaagtgctcggcctgcaggcggcctgcacgatccccgacgatgcggacaccgtgctcgaagcgatcaaccagggccatccggtgtcgcggctcgcgcgcggcacggcggtcgtgcgcgcgttgcaaggctgcgcgaagcaactcgtcgacggggaggtgcgcgcggggcactgcaccacgcaaagcgaaccgctgatgtcccggcttttcggccgcagggccacgccgaagctcaagtccatgtaaatctttcgggaaccatcatgtcattgcgcgaacagatgtcgttgcaccgggcccagccgcacgcggcgggcagcgaaccggccggcccggcgcattcgtcggtgcgcgacgcataccagaagctgcgccgcgaaatccacctggccgtgctcgaacgcgtcgagctcgagcgcctgtctcggatgcagcaagagtcggtccgcatggagatcggcgccctgatcgcgcgcatcctcgacgaggagcggctgcccgcgaacgacatcgagcggcggcagctcgcgatcgacgtgtacgacgagatgttcggcttcggcccgctcgaagcgctgctgcgcgaccccggcatttccgacatcctcgtgaacacgtaccggcaggtctatgtcgagcgcgccggccagctcgaactgaccgacgtgacgttctacgacgatgcgcacctgatgaaggtgatcgagaagatcgtgtcgcgcgtcgggcgccgcatcgacgaatcgagcccgatggtcgatgcacgcctgccggacggctcgcgcgtgaacgcgatcatcccgccgtccgcgatcgacgggccgctgatgtcgatccggcgcttcgcggtcaacccgctgaagatggacgacctcgtgcgctaccacagcctgacgccgccgatggccgaactgctcgatgcgctgtcgcgcgcgaaggtgaacgtgctggtgtcgggcggcaccggcagcggcaagacgacgctgctcaacatcctgtccggctacattccgcgcaacgagcggatcgtgacgatcgaggacgccgccgagctgcaactgcagcagccgcatgtgctgcggctcgaaacgcgcccgccgaacatcgagggcaagggcgagatcacgcagcgcacgctggtgcgcaacgcgctgcggatgcgccccgaccggatcatcctcggcgaagtgcgcggcgccgaagcgctcgacatgctcaacgcgatgaacaccggccacgaaggctcgctcgcgacgatccacgcgaacacaccgcgcgacgcgctgacgcggctcgagaacatgatcagcgtctccggcctgacgctgccgccgaagacgatgcgccagcagatcgcatcggcgatctcggtggtcgtgcaggcggcgcggctgacggacggcaagcgcaagatcgtcagcatccaggagctgaccgggatggaaggcgacatcatcaacatgcaggagatcttcacgttcaagcgctcgggtgtggatcgcgacggctcggtacgcggccacttctgcgcgaccggcgtgcggccgaagttcgtcgagcggctgcaggcattcggcatcaacctgccggattcgctgtacgacccgtctcagcggtacgagacgaactgacgacagggcgctgttcgctgccggggaggcttcatgaacacgatcttttacggttttgtgattctcaccttcgtcgcggtggtgctcgcgatcgaagggggctatcaatggtggaacgcgcggcacggctccgccgcgcgccggatcgaatcgcgcatccgctcgatgtcggcaggcggcaacgttcagcaggaacggctgtcgatcctgaagaagcgaatgctcgacgaatcgaagccgttcgaccggttgctgctgcgggtgccgcgcgtgcaccggctcgatctcgtgatccagcaatcggggctcgactggacgctgccgaagctgatcatgctgagcacggtgttcacggcgttcgcgtggctcgtactgagcttcgcgacgctgccgcaactcgcggtgctgccgctcgcactgttcgccggatgcgcgccgatcatgtacgtgctgcgctgccgcgggcgccggatgcgcaagctcgagcggcagttgccggacatctgcgacatgatcgcgcgcgcgttgaggtccggtcactcgttcacgagcacgctcgggatggtcggcgacgagtttcccgacccgatgggcggcgagttccgggtcaccttcgacgaggtcaactacggcgtgccgctgcacgacgcgctgatgaacctcgccacgcgcgtgccggtacaggacctgcgttacttcgtgatcgcggtgctgatccagcgcgagacgggcggcaacctggccgagctgctcgacagcatcgccgcgctgatccgggagcgcttcaagctgttcgacaaggtgcgcgtgctgtccgcggaagggcggctgtcggcatggattctcgggctgctgccgttcggcacagccgcggtgatggccgtgctgaaccgagaattcctgtcggtgctctgggaagatccggccgggatcaggatggtcggcacgatgctggtgtcgatgttgttcggcctgttctggatccgccgcattgtccgcattcgcgtctgacgcgcgaatcgtataacgaaccgttgcgaggctgtcatgcaaaacctgagcgtagtccaggccgtgatgctgggcggcttgttcatcttcgtggccggcggcgcgcttgtcgcgatgctgctgttcgcgccacgcagcatccagcgccggatccagcaggccggtggaaccggggcgggcgcgactgccgtcgcgggcaccggcgacggcgacgacctggcgtcgcgctgggttgcgaagctggtggagctgtctaccccgatctcgaggctgtcggtgccgaagcagggctgggagaattcgccgctgcgcatccggctcatgaatgccggctggcgcaaccagagtgcggccgcgctttatttcaccgcgaagacggcattggcactcgggttgccgtgcgcgcgctgctggcgctgatcacgacccggctcggcgacgagcgcgagatcctgtcggtcatcctcgtcgcgcttgccggcatcggctactacatcccgaacatcgtgctgtcgcagcgggtcaaggtgcgccagcagaagatcttcgaggatttcccggacgcgctcgacctgctgacggtctgcgtcgaagcggggctcgggctcgacgcggcgctgatgaaggtgagcgaggagctgcggttcagcagcgaggtggtcgcgagcgaactcgacctgctgctgctcgagatgcgctccggtttcacgaaggagacggcgctgcgcaatcttgcgctgcgtaccggcgtggaggacatcgaggcgttctgcgcgatgctgatccaggccgaccggttcggcacgagcatcagcgaatcgctgcgcgtgctgtccgacatgctgcgcacgcggcgccggatgcgtgcagaggagcgggccgcgaagatcgcgttgaagctgctgttcccgttgatcttctgcatcttccccgcgctgatggtggtgctgctcgggccggccatgatccacgtctatcgcgtgctgctgccgacattcgttggcatcgcacagtgaacgacgagccggaattgcgccggaatcgacactgaaggttcagcgtgccgggcggccaccccgccggccggcacggcgacaggcttcatggaggctccctcccaggcggcgccgcgagacaggttgaccatagcggcgtcaatgcatcctggacccatggtcggccatggaagtagccgtagtccaccgcctgatcggctgccccctactgctaacctgaatgccggcaaagtttgccggcatcacgttgtacgcgatgcagcggtgttcgcgcggcatcacggccgcccttcgctcggcacttcggccgccttgctgagctcgcccatgacgatctgcgcgatcacgttggccggtgcgcgcccatccggcgcggccgccgtgttcgcccacgtgacgatcgtcgtcttcgtgaccgggtcgtagcccatgaaggtattgaagcccgggatctcgcccgtatgtccgtagaacgtgccgaatttggccaggcccaagcagtagctggccgacctcgggtcggacgaatcgatcggcgtgcaactggcgagccgttgcgcctgaaggttggcgttcaggtagccgccgccgaccatccgctgcacgtatgcggccagttccgtcacggttgaaatgccggagcccgccgtccacgcccacgacgtattcacgcgggtcacgttcgtcggttgcagcgtgccgtttttcgcgtccgcctggcgttggggcgacagcgcgtcgctgtcggtcgtctcggcattggtgccccattgatagccctgcggcgccggtgccggcagcgacgtatcctgctgcggcgggagcaaggtattgaccaggccgagcggcgcgaacaggcgcgcgttcatcgcatcggccgcgctcatgccggtcagttgctcgatgatgagcccgagcagcaccgtgttcgtattcgagtagcgaaaatccgcgccgggcgcgaaatagaccggctggccttcggcgatccccagcagttccgacgtggtccacaccttgtccggctgcgcgtcgagcgtctggttgaacgcgagattcgtcgaatagttgtagaggccgctgcgcatggtcagcaactgttcgatcgtgatcgtattgccgttgggcacgttcgcgacgaacttgctgacggtgtcgccgaggctcagccggccttcctggacgagttgcaggatcaccgtgccggtccatgtcttggtcacgctgccgacgcgaaagtgcgcgttcgtcggtatcggcgtgttcgtgccccgcacggccgtgccgaacgattcgagccagttcccctgcggcgattgcacatagacgactgcgccgggtgtctgcgtatccgcgagcagggcgttgatctgcgggcgcgccgcgttcgcgaacgccggcacgctcgagcccggcgaactgtcgccgccgcacgcggaaacggcgatgccgatgaccacggccggcgcgacggccacgatgccgtgagtcagccgccgcgatacgttcgacaagaaccgggaggttgctgaaggattcatcgcgcgggtcctccgtggtcgtgacgtattgcctgcgttgtcttctccaaaactataggacaggcgcgccggtgcgggcagcatgcatcattcgtccgacgaaaccgaccgggctcgttcgtccggtcgcggccgtcactgaaagtgatgcacgtaccgcagcaccatccgcgtgccctgcggccggttccgcgcataggtctcgaaatacgcgttgaacatcaggtggtcctgctgcgagaagctgtacatggcccccgggccgatcgcgaatacggcctcccgcgtgcccggcacgtcctgcccgttttccttcatgtcggtggtctggcgcagccagtagccgttgagccccagccgcaggccggggcgcacctcgtactcggtcgcgaagttcgcgtggatcgcctggccggcctgcgtcgacgtcacgtccgggccgagcgacgtggccggccgatggttggtcgtgttccacagatagtgcagccgccacgacacggtccatttcggcgtgagccacagcgttgccgcccagtacgggtcgaacgaccaggcatggctgcccgggttgatcgcacgcgacggatcgtacgcgccggtcggcgcgatgaactggaattccacgcgcagcgcgaagcgcgggccttgcgcgcccatcaccgggtcgaactggacgaacgggccgatcagcaggtcgccgaagccggcgcgcgcattcagcgcgacgttgccgatgccgtcgtcggtccgcgccgacgcgacccacggcaggatcacgtcgaggcccggatgcatgcccgcgaacgtcagcggcgactgatagacgagctggctcagccccgcgaacaggtcgatgtcctgcttcggcaacccgaccttgttgcccgcgttgtcgttgacgcggccggccgtgtagtactgcaggtactgcgtgccgtaccagccggagccggccggcggcatgccgtcgagaaagctggtcatgccgaggttgaccgccggcaggtcggttgcgcgggccggcgcgcttgcggccatgccggcgatcgagaggcccgcgacgacgagcaggcgagagccgaatttcatgttcaccacctcctggttgtttatcggtataactaatcaaacggcgcgaaaaagatcggggtgatcggtgatcgcgcgatactggcccgcatgaaacaccagcggcgccttgccgaacgcgtcgaactgctcgatctggccgatgaagagcaggtgatcgccgccttcgtaatggccgacgttgcggcacacgaagcgcgcgctcgcgccgtcgaggcagggcacgccgccggcgtccgaatccgcgtgcggcacgccgtcgaacttgtcggcgctgggcgtcgcgaagcggcgcgacaggtcgatctggtcgtgcgcgaggatgttgatcgcgaaatgggtggccgcgacgaaatccgggcggctcggcgcgaccttgcgaaggctccacagtacgagcggcggatcgagcgacagcgacgagaacgaattggcggtcaggcccaccttgcgtccatcggccgcgcacgtggtgatcacggtgacgccggtcgggaactgcccgaacgcggcgcgcagctgcatggggtcgagggtcgggcggtcggtagcgatcgtttccatgtcggttactcgaacgcgcactgtgctcgcggatgaacgccgcgcaggccgacggctcgaaccaccacggcgagaaccggcgcggatcgtcgaagccgtcgacgatcgccgcggcgagcgacggcaactggccggccgcaccgagcagttcgaggatgtgcggcggtggcggggtgagcagcgagttggtccagcgcacgacatgctgcgcataagcccagtagccttcgaacgtctgctgcatccagtcttcactgaacggcgcggcgtcgcgcgcgacgatcgcatcgaaatatgcgttcgcgcatttcgcggcgttgttcgagccttgcccggtgatcggatcgttgacgaccaccgcatcggccatcccgaacaccgtgcggcccgacggcagccggaagaacggcttgcgcaccgtcggcgcgaagcgcccggccagcgtgccgttcgaatcggtgagctcgacgtcgcgacagcgctcgaattcccacggcacgtattgccgcaggaacgacaggctccggtccagatgctgctcgggcgtcttcacgtcggcccagcaatcgagcgggccgcccggaatgccttcgaacaccatgatttcgcacgggcccgtcgtggtcagcgcggggaatacgaaatactcgccgatgccgggcagcaggttgaagcgcacgcgcgaatacggctggctcggcgtcatccctttcacataggtgagggccagcgcgcgttgcgggcggtcgaacgtgctgcgcgcgtcgtcgcggccgagcaggttgacgatctcgcccttgccggccgcgagcagcacgaggtcgtggctgcgcgccagttcctcgagttcgggcacaccgatgtcgccgatgcgcacgtccgcgccgcggcggcgcacgccgtcgagccagtcggccattttcacgcgctggtcgaccgattgcgcgtagcgggtcagccgcgacgaccagtcgatcgccttgcggccgccgccgtccggatgcggtaccgcgatgccgattccttcgacggacgggcacgcttcctcccaggtgttcaggccgaggtcgcgttcgatctgcagtgcggtatggaacatgcactggctcgacatgaccttgcccgtgcggatctgttcggcgtcgcgattggtcgcgagcgtcacgtggtagccctggccgagcagggcgaaggcgagttgcaggccggactggccggcgccgacgatggcgatacgtctcatggggatgtccttggttggccggatgccggccggaatgattgcgggaagcggcggcggggaacggtcactccgcgagccgcggaatggccggcaccgcctgttcggggcccatcgcggaataaccgccatcgaccgcgtagtcggcgcccgtcacgaagctcgccgcgtcgctgcacaggaacgtcacgacctgtgcgacctcggacggatcgccgacgcggccgagcaggtggaacggcgcggcgacgcgatcggtcttcgcgcggtcgccgtgcgtcagctcgtccatcacgcgcgaccacgtccatcccggcgataccgagttgacgcgaatgcgctcgggcgcgagatccatcgccatgctgcgcgtgagctggcggatcgccgccttggacgtcgggtacagccagcggccggtctgagcgcactcggccgagatcgagctgaagttcacgatcgcgccgccgccgcgccgggccatgtgcggatggacggccttcgcgagcatcgcggccgacacgacgttgacgtccatcgcggcgagccagtcgttgcgggtcgcctggatgccgttgtcgacgtagctgcacgcgaggttgacgagcacgtcgatcgcgccgaaccgctcgacgatggccgatatcgcacgttcgatcgcgcgatcgtcggtgatgtcgagcgcgacaaacatggccttgtcgccgagcgaaccggcgacgcgcgcgccgttgtccgcgtcgagatcgaggatcgcgacgcatgcaccggcgcggctcaggtcctgcgcgaccgcggcgccgatcagcgtggcgccgccggtgacgatcgcgactttgccagcaagggcagtcatggggtgtctccgtgaatcgtggggtgagggaggggcgcgtcagtgcgcacccgtcgacggctcgctgtcctgccagcggcgcatcaggccgttcgacggcacggtttcgtcgagcagcttgcgggccgtttcgacgcccgcgaccggcaggccggccggatcgagcaggccgatctgcacgagcacgctcgcctgatcccagtagatgtgttcgtgatagagcttgtcgccgcgaaacttgacgatcgcgacgagtggaatctcgacgcgcttgccggtgggcgcgacgcccggcagcatccagtcgatctcggtggtgtgcgtgaagcagaacagcagctcgtcgacgacctggctcgcgccgatcgtgcgcgagatcggggtgatcgtcgtgtcgggcggattcgcatgcacgaagtgatgcgtgtagaagcgcttgagttcgtcgtggccgacgccgcccgtcagcgtcggaacatggttgacgtacggctcggcgaccatcgtcgccatcgtggcatcgacgtcgcgcgtggcgaattcgtgttcgagatgcgcttcccacagtgtggacaggtcgtagtgcgggccgagcgcggcgcggaacgcggcgatcgcgcgctggtgggccatgaccgcggcggccttgtcgaaatgatcgccgccgacgcgggcgaacgcgtgatcgacgcccggatacacatacacttcgacgccgtcgcggccggacagcgcgtcggcgatgcgctgctgcgcgtcgggcgggcagaagcggtccagccccgcgatctgcagcacgagccggccctgcaggtgcgcggcctcgtccagcgcctgctcgatgcccacgccgtagtagctgaccgccgcggccacgcccggcagccggcacgcggcgagataggcgagcttgccgccgaggcagtagccgagcacgccggtttcgcccgtgcattccggctgctgcctgagcgcgtccagcgcggcaccgatgtcctcgacgcccttgtcctcgtcgaattcgcgatacagggccatcgcgcgctcgacatcggcggctgcatggccgagctcgatccccggcgcctggcgccagaacaggtcgggcacgagcaccgtatagccttcctccgcgtagtagtcggcggcctcccgcatcgtcgcgtttgcgccgaagatctcgtgacacagcacgatgcccggccccccgccggccggtgtgctcaggtaggcgcgaaacgttccgccgtccggcgacggaatcccgatgtgacgtcctttcatctgtccctccgttgaattcattgctgcgacgagcccagtattggcggacgaaacgtgcgcttctatccgctttcttcggccggtatccgcgaattccggaaacctgcggcaccggccgccgcgcgtgggcaggcgcgcggccgactgcgggtatgtgcggatgcggaaagcccgcacagttttctacgatgcgcgaacggtccgtttcttgcgtcgtttgcgcgggacttgcgtgctttggcggccggactgtccggatactccgggcgctatccggatcgtgcggcgaatgccccacaccgggaacgcatgcacggcgcgagtgcaaccgagcatgacgggagaacatcgatggcgcaattttccggaacgggctggctggccgacaccgcctgtttcaatcacgacaatctgctgctgcagtcgaacgatgtcgacgaggtgcgcgcgcgtgtcgccgacgtcttcaagccgcaccggctcacgccgaccggcgaatcgcgcgcgctgcacagctgcatgcatcatgcgcgttggggcaacctgtcattgaacctgctcgattacggcggcggggtcagcatcgagcccgggccgctcgagcacttcttcctgttgcagatccgctgcgcggcgacgcggagatcgagtgcggatcggcgcgtttcgtgtcgtcgccgggcaccgcgtcgttgatctcgccgacgctgccgctgaagatgcgctggggcgacgcgtgtccgcaagtcatcgtgcgcatcgagcgcgaagtgatggagcgccatgcgcagcggcatttcggcgacgaccggcgcgcgccggtcgaattcgaaccggcattcagcctgtcgtcgtcgcaaggggcgtgtctcgcgcagttgctgccggtcctcgccggcgcgatcgcgacgcacgcgcatccgctgcgtcatccgctcgcgttcgagccgctcgaatcgacgctgctcaacctgctgctgcacggccacccgaacagcgcgcgcaacggcacgcggcacctgccggtggcgctcgcaccgttctatgtgcggcgcgtcgaggattacattcgcgcccatctcgacgagccgctgacgatcgagcggctcgccgacctcgccggcgtgagcccgagcacgctgttcgccggcttccgccatcgccacgggatcacgccgatgggcttcgtgcggcagttgcggctgcaacgtgtgcgcgaggaactgctggccgacgagtcgccggggctcgcatcggtgacggacatcgcgctgaaatggggcttcgcgcatctcgggcgattcgcgatcgagtacaagcgggcgttcggcgagtcgccgtcggcgacgctcaggatgcggcgcgtgcgcgcctagaccctccgacggcagcccacggccgttcccggggcgcatgcagcctggcgttcccgtctttcatctgccttcctcgcgagccgccgcacggatcgatcccgcgccggcccgcctccaacgcgccaaacgccggcttttccctccggcgcactttttaaagactccgttacgttcgcccggtatgatcgctgcgctcgcgaacgacgccattggccgttgcatgccgactcgcgcgcaaccagcatcgccggcatgacaacacggggcggacgccggcggtgcgtcgcgccgcgatcgggccgcgatcgggtcgaatcggccaccagcacgacggagcatggaatgatggtaacggggacgggcgcggcgaaacgcgcgatggtgatcgccgccggaggcgcgttgtacgtggcggcagcgggcggcgcgcacgcgcaggcatcgggtgcggcagcgccgccggcggccgtgctgccggaaatcgacgtaacggggaagagcgaccgctcgtcgagcgggctcgtcgggctgcgcaccacggccggcacgaaaaccgatacgccggtggccgaagtgccgcagacgatcaacatcgtgaccgcgcagcagatcgagatgaccggcgcgaccgacctgaaccaggcgctgcgctacgtgccggggttcgcgacgttcggcgccgacagccgcaccgactcgtatgcggcgctgcgcggcttcacgccgacgctgtacgtcgacggcgtggccgcgccgcatacggccgtgatcgcggactggcgcgtcgacccgtacacgatcgactcgatcgcggtgctgcgcgggccgacgtcggtgctgtacggcgcgggcgagcccggcgcgatcgtcgacgcgcacacgaagctcgccgacggcgaacgcgtccgtgaagccggcgtgcagatcggcaacgacgcgcgcaagcaattcatggtcgatgtcggcgatacgctcgacccggacggccggtacgcgtatcgcttcgtcggcgtggcgcgcgacggtaacgcggaaaccggcccgaacggcgaccgtcgcgtcgcgctggcgccgtcgttccgctggcggccgaacgccgacacgtcgctgacgctctcggcgacgttcctgcaggacagcggcgatatttcgtcgaacttcctgcctgcgtcgggcacggtgctgccgaacccgaacggccgcctgtcgcaggacatctacatgggcgaccccgggttcaacgactaccggaagaagcagtggtcgctcggctacgcgctggagcaccgcgtgaacgcgatctggtcgctgcaccaggacgtgcgctggtcgcacctgtcgctcgacgacgcgacggtgttcggcaacggcttcgcgccccgcagcaccaccaacatgatgcgtaccgcagggctgttccagctcaactacagccggctcgacatcgacaaccacgcgcaggcccgcttcggcacggggccgctcgaacatacgctgctgctcggcgcgcaatatgaccggcagacgacgaccaacagcgtgtggcttgcgatcgcgccgtcgctcaacctgtatcaccccgataccggcccgtcacggacgcgattttctccggcccgacgtcgctcggccacgtcgaccagtacacggcgatgaacacgttcggcgtacgcgcaagaccagatccgctggaagcgctggacgctgacgctcggcggccgcgaggatttcgtcaatgcgcggttcgacgaccggacggccggcaagcaggcgcggcaggacgtcagtgcattctccgggcgcgtcggactcacctatcggggcgacgccgggctgtcgccgtatgtgagccattcgacgtcgttcgatcccgtcatcggcgtgcggttgtatggcggcgggctgccgaagccgacacgcggcacgcagacggaagccgggttgcgctggcagccgccgggccggaacctgatgctgagtgcggccctctaccagatcgaccagactaatgtcgtgacgccgacgccggtcaatctcgacccgaccggcacgacgtccgtgcagaccggcaaggtccgctcgcgcgggatcgagctgagcgcggtcggcaaggtcacccgcgagttgtcggtcgtcgcgtcatacgttcatcaggacgtcaagaacgtgcaggcgaacgacgcgtcgctgaaccactggccggtggccgtgccgctgccgcggcagatggcttcgatgtgggccgactggacctggcgcacgggcgcgctgtcgggcctcgggctcggcggcggcgtgcgttaccagagcgcgtcggcgggcgcgcccgacaactcgctgacggtgccgagcgtgacgctgctcgatctggcgctgcactacgagatgccgcactggcggttcgcgctgaacgtcgcgaacctgttcgaccggcgttatgtcagcggttgccagtcgtacaacgtgtgcgtgttcggcaacgagcggaccgtgctcgccagcgcgagatacaactggtaggcgcgagcgcgcggaacgcgtcctacacgtcgcgttgcggctccggcgcgcggcgcgttcacttgcgtggcgctggcgccgccactcggtcggcgtgaggccgaaacgttcgcggaatgcggtcgcgaaattcgccggcgtggaaaaaccgatctccttcgcgatgctggcaatgctgagcgacgtcgaatccagcagatcctgcgcgatccgcaaccgctcgtgccgcagatactcgaacaccgtctggccgagattgtcgcgaaacgcccgtgacagccgcttttcatgcgtgccgaccgcgcgtgccagttgttccaccgtcggcggatcgttcagcgtccgcgccaggtggcggatggccgcgcgcacgatgatgtcgtcgtccttgccggtcacgaacacgctttccgtgtcgacgggccgctcgcgcgtcgcccgcgcgagctgcacgcgaatccgcgcgagcacttcggccggctcgaacggcttcaccacgtagtcgacgcagccgatctcgaacccctcgaggcgttcgtgcaacgcgcccgccacggtcaggaagatgacaggaatcgcgcacgtcagcggatcggcggctagcagccggcacgcggtgaagccgtccatgcgcggcatccggacatccatcaggatcaggtcgggcatgagcgcctgcgcgcgctggcacgcctgcagcccgtcggatgcaatgctgatccggcacccggtgccgcgcaggatgtcgatcagcaagcgaagctggtcgggctgatcgtcgacgatcaggatatgggcgtcgcccaatgcggaggtcgatggatgcatcgtgcacctgttctggaatggctgctggctgcgttcctgcgggtggccggcccggctcggataatcgttggaaactgctctatggcaacgcacaagcgcatcgatattcggatttcgcgcaaaccgcgcgacagacgaccggtcggcgtaatacccggcgttgcttgtattgatcgctgatccggtaaggacgcgaagcgttgccgtcgccgcgcgtggaaaagggcgcggctgaccgtgtcgatgcgagccgaattgtaggggatatttcgattcttgccagacgcattgactctatttacttcattccagttttctgattcttaatcagatattgtgatttgcgttagcggtgtggcaccctgatgcctgtccatttccgccattttcattcttgcccgcacgcgatcgcgcggctcggtagtttttctgtagaaatattttcgctgaaatttatttttaatccgcttcggcaaagcatttgtccgctcgacaaaacatctggattaattccggtgccgcgaaatcgtttgcgaggttcgtgtttttcatgcaacttattgaatatattggattttacaatctataaagaatgtcgccttcaataatttaagtgcgtgtctcataattcgtccgaactttgaacgcagggttgcacggggcagcacaaggcacggagggttgtgacggacgttgcgtgattcggggccgtggcatcaattgatgctcgtccgaacgcatgtccgtagcgctcaggcgcacgtccggttgccgtcgatgaaataaaagaagcggggttggtcgcggtcggcgcgacatcaaatcaggggtgtccatagcggcgggttgaatctccggattcagtcgatgggcgaattcgcccatataaaacgatatgcattcctaatgcattaaccggattaacggaacggaccgtcacaccaacggcgtgcccgggctttcgaacgtcccgtcgctacgggcgggcgatgcgtgtcgccttcggcacgctcgggccgggcatcggaatcgggttccgcactgaagtcgtaatcgtaatcgcagtcgcaatcgcagctgaatccttcaagcaaattaagtagtccgtatacaaaccagacgctacaaaacggagcagaagaccatgaagaggaagcagatttcggcgctcgccgccgccatgttcacgggtgcaggtgtcctgatcgcgggggccgcgcatgcggacaacttcgtcgaccgcggcaacccggacaacgcgctgaacggccagtgcatcgacgggacgaacccgctgtgcgtgtcgaccaagagcggaagttacgtggcggtgagcacggcaaacgtcacgatggggacgaacgccagggccggtaccagcgggatcgcgatcggcgatcagtcgaatgcgagcagcaagggcggcaccagcagcgggggcgcgattgcgatcggcgtcggttcgcaggcgctggcaaactcggccacggcgatcggcacggtagccgtcgcgcaaggcaatacgtcgctcgccgttggccgccagtcggccgcggtcggcgacttctcgatggcgctcggcaacgtcgccgatgcgcgcggcacgagctcgatcgcactcggtcactcggcgctggcaagcggcgaccgttcggttgcgatcggcggtgcgaacccgacttcgagcgacggcgtgtcggccggcgcgtcgtacgacgcggcgacacagacgcgcgccggcggcacgcaatccgtggcgatcggtgcgggcgcgcagacgaacgacaacaaccaggtggcgatcggctcgggcagcgtcggcgcgaacaacggcggcacgccggtgttcggcggcacggccgcgccggtcggcggcgcggtgtcgttcggcgccgtcggcgccgagcgtcagctcaagaacgtcgcggcgggcgcggccgatacggatgccgtcaacgtccagcagctgaagaacgtgaacggcacgctcagcacgagcatcgccaacgtcgacgcgcgcgtgacgtcggtcggcaattcgctgtcgaccacgatttcgaacgtcgaccagcgtgtgaccagcgtgggcaacagcctcagcaccagcatcgtgacggcaacgaagaacgtcgtgaaatacaccgacgattcgcatgcggcgatcgcgctcgacggcagcaacggcaccacgatcggcggcgtcgcggccggcgtcgccgacaccgatgcggtcaacgtcggccagctgaagggcagtgtcgccccgctgcagacgtccatttcgacggcggcgtcgaacatcacgaacctgcaaagcagcgtcacggacatcaatacatcgctgagcacggcaacgacgaatatcggcaacctgcaggcggccgacgcacgcaacgtcaagtacgacggccagagcggcttcgactcggtgacgttcgccggcacgaacggcacgacgctgcacaacgtcgcggccggtgtcgccgataccgacgcagtgaacgtcgggcaactgaacggcggcctgtcgtcgctcagcacgagcgtgacgaacaacctcagcacgacgctcggcaacctgagcacgtcgatcaccaaccagatcggcgacgcgacgaagaacgcggtgcagtacgacgatgacgcgcacagcggcgtgacgctcggcggcaagggggcgcagtcgccggtcggcctgcacaacgtggcggacggcgttgccgcgagcgatgccgtgaacgtcggccagctcggcaaggcaaccgactcgctgaaccagtcgattacgaatgtcggcaaccaggtgacgacgaacacgggcaacatcgcggcgctccagcaggacgcgcttctgtggaacacgaacctcggcgcatacgatgcgagccacggcggcaacggcccgcaacgcatcggcaacgtcgcggccggcgtcgccgacaccgacgcggtcaacgtcggtcagctgaacggcagcgtcgcgccgctgcaatcgtcgatctcgaccgccgcgtcgaacatcacgaacctgcagagcaacgtcaccggcatcaacgcatcgctgagcacggcgaccaccaacatcagcaacctgcagacggccgatacgcgcaacgtcaagtacgacggccagagcggcttcgactcggtgacgttcgccggcacgaacggcacgacgctgcacaatgtcgcggccggtgtcgcgaacaccgacgcggtgaacgtcgggcaactgaacggcggcctgtcgtcgctcagcacgagcgtgacgaacaacatcaatacgacgctcggcaacctgagcacgtcgatcaacaaccagatcggcaacgcgacgaagaacgcggtgcagtacgacgatgacgcgcacagcggcgtgacgctcggcggcaagggcgcacagtcgccggtcggcctgcacaacgtggcggacggcactgccgcgagcgacgccgtgaacgtcggccagctcggcaaggcaaccgactcgctgaaccagtcgattacgaacgtcagcaacaacgtgacgacgctcggcaaccaggtgacgacgaacaccggcaacatcgcggcactccagcaggacgcgctccagtggaacgcgaacctcggcacctacgacgcgagccacggcggcaacggcccgcaacgcatcggcaacgtcgcagccggcaagaacggcacggacgcggtcaacgtcgaccagttgaacgcggcgatccaggacggcacgagccagctcgacgcactcgccgtgaagtacgacgacgcgagcaagaagcaggtttcgctcggcgcaggcaacggcgggagcccggtgcgcctgaccaacgtcgcggaaggcaacgtcgcggccggcagcacggacgcggtgaacggcgcgcaactgcgccgtgcaaccgacggcacggcggccgcgctgggcggcggtgcgacggcgaatccggacggctcgatcagcgcgccggactataaggtcggcggcggttcgttcaacaatgtcggcgacgcgctcacgaatctcgacggccgcgttctcaacaacacgacgacgctcgagaatcacgaaacgcgcatcggcaatgccgaaacgaacatcgccggcaacacggccgcgatcgcggggctgcagcaggacgcgctgcagttcgacccgacgctcggtgcctacaacgcggcgcgcggcggtgcgccgacgaagctgacgaacgtggccgacggcaacgtcgccgcgggcagcacggacgcggtgaacggcggccagttgtcaggcgtgaagtcgtcgctcgaacagcagatcacgcaggtgtccaaccaggcgggcgaggccgtgaagaacgtcgtcaagtacgacgtcgacgcgaacggcaaccggttgaattcggtatcgctcatcggcggcgacccgaatgcggccgtcgtgctgaagaacgtcgccgcgggcactgccgataccgacgcggtgaacgtcaagcagttgaagggcgtgcagtcgagcctcaaccagctcggtgcgctcgcggtgcagtacgacgacgcgtcgaagagctcgatcacgctcggcggcgcgggcggcacgcgcatcaccaacgtgcaggccggcacgctcagcgcaaccagcacggatgcggtgaacggctcgcagctctacgcgacgaaccagcaggtcgcgaagaacacgaccgacatcacgaacctgcagggaacgtgaacaacatcgcgaacggcaaggccggcctcgtgcagcagcaggatccgaacggcgcgatcacggtcgggaaggacaccggcggcaccagcgtgaacttctccggcacgtcgggcgatcgcgtgctgaccggtgtcgcggcgggcgtgaaggacaacgacgcggtcaacatgggccagttcaacaacgcgctgaagaacgcggcggccaacgaccagatccgcgcggcggcgaccgatgcgaacacgacgtggatcacacgtgccgatgcgggttcgatcgggtcgacggcaaccgcaaccggcaagaacgcggtggcggtcggccagggctccgtcgccgatcgcgacaattcgttctcggtcggtgcgaagggcagcgagcgccaggtcacgaacgtcgcggccggcacggcgccgaccgacgcggtgaacgtgcagcagctgaacgacaacctgtcgaccgccacgtcgcaggcgaagggctacaccgaccagcgcatcggccaggtgtacaactcgttcaacgacctgaagaaggacatgtacggcggcgtggcatcggcaatggccgtggccggcctgccgcaaccgacgggcgcgggccgctcgatggtctcggcggcgacgtcgaactatcacggccagcagggtttcgccgccgggtactcgtacgtgacggaaagcaaccgctgggtcgtcaaggcgtcggtgacgggcaacacgcgttcggacttcggcgcggtggtgggcgcgggttaccagttctgacgttgtccgcgcagtatcgatcgaacggtggtgtcgggcagcggtcgtgatgcccggcaccggcggagatccgtggcccggggtgtgtctgtcgaccccgggccatcgacgcttgaggcgtcgcgaagagcggtatggctacgccgggctcgtccggcagccgatgccgtcgatggatgatttattcgccgattgtggagataatcggcgctggcgcaatgcactccgcattgagcgtgtccgagcacgtcttccagtcccgtattggcgccgacaacgacaaaatgaaaacgatgaaacccgagaacaggatgcttcccgcgcagcgcgtcgcgttgccgcgtcagattcggcggcacgccttcgcggcgagcgccgccatcgcgtcggcttttccgcccggttacggcggcaggtaccgctgagcgcccggacaatccacgggggtaaaggcacatgatcgggaagtttgcgtggctgtccgtcgtttcgcttctggtcgcggcatgcggggatcgttccggtgaggtcgatacggcatcgaatgcgcagccggcggccgcgtcggcgacgcaggccattacctcgcagcgcgaagggcgcgactcgcccgtgccgcccaggcccggccaggtgctcgagggcatttaccagaaggacgcgcatggcgaggcgacgatggagatcgccaacggaagccaggccacgtattggtacggccacgcgttcgacctgaacggcggccactacttcaccggcttcgcgtacgagacgccgaacaagtacgccgaacaggagaacaccgccgagccggcgcccgatgccagggtgacgatcacggaggcgaccttcgaatggatctcggacggcggcgtggccggctggaacatgatcgagtcggaacgctcgatcggcgagtttggccgctacgaaaaggctgacacgatcgacgacagggaaccggccgtgagcacgaccctgccggacgggcggatcgtgctggccgtgccgacctggtacctggcttccggtacccggatcaagtcgttcggcatgttcgtctatcggcgcaccgatgcgtccagcaatcctgacgataccgactggacctatgccggcaacgtatttcgcggcaatgacagcggcgcggcatgcgatgccgcgggtaccggcaaccggataccgtgcgtggaaggctcggcgacgctgacgttcctgccggcagacggccgggactggccgcgccttcgcgtggcgatgaacgggacgggcatcgacaacgccggccggaaaaagatttacagcgccgcggatgtcgtcgaataccggttcaatccgaagacgaaggtttacgaagcggtgaagacgtagggcggcatggggcgtgtcgctttcaacgatggttccacctgtccagaaagaggatccaatggagatggctctctcgagaaacaaggtgggcggctgccggaagtgacgtggctcagccaaatcacggacaaatgcgaatggcgcgatccgcagcgctcgcaaccgcgccccgatccgcgatttctcgcgggttcgcgcgctgtcgagccaggcggcgaatgcgaattgtcgaatgcgagccgcggctcgtattctgggtgcgtcgggcggaacggcatggggcctccgccgatcgacgcatgacggagactcgcaatgactgccatgacgcaaaccatgaagctcaatcacctgagcttccctccgccgacacactggcgacggcccgattcttcgagcggcatctcggcttcacgatcgcgggaagctgggataaatcctggatcctcaagcgcccgggcttcgacgtagtgatcgatcacgccggcgacgatgagaccgcgtggccgacgaatttccacgtcgggttcgaactgccgagcctcgatgccgttcgcacgttgttcgaacgcttcagggaagagggcgtcgagatggtgacggacgtcttcaacaacgggcgcggttcgcgattcttctgccgcgcgccgggcggcgtgatgttcgagctgaacacgcgcgcggatgccgcgccggaatatcaaggcacgttcgacgactgacgccggcaagcgtcgtaccgcgttcgggtgccggcgcgggccgccgtttcaatgaccgtgcaggtcgggaaggctgcgcatctccatcacgtgcagatcgctgcagcgcgcgacatggccgtgccgcaccacccgcgatgccgttgcaccggacttcaacagcaagaaacggagtgtctgcctgcaaacggtcgcctacattgccgtgactaaccccactcacgggatgtgaagaagatgaccttactcgaagggaaagtcgccatcgtcaccggtgcctccaccggaatcggccgggcgatcgcactgatgttcgcggcgcatggcgcgtcaatcgtattgggcgcgcgaagtgaattcgcgttgaatcaggtggccagcgagattcgtcgtcacggcgggcaggcgttcgcctgcgccggcgacgtctgtcacgtcgatacgcatcgaaggctcgtcgcgacggccctgcgcgagttcggcggtctcgacatcgcgatcaacaacgcgggaaccgtcgggccgctcaaaccgctcgcggacatctcgctcgacgattggcagcacacgctgtctaccaatctgacggccgccttcctgggcgcaagcaaccagattcccgcgatgctcgaacgcgggggcggctcgatcgtcttcacgtccagctttgtcgggaccagcgtcgggctacccggcatgtccgcgtatggtgcgtccaaggccggcttgatgggactggtgaagggcatcaccgcggactacgcggcacggggattcgggcaaacgcactgttgccgggcggtgtggacaccgcgatggggagaccccgagcaaaggaatgggcggccgggctccacgcgatgaagcgcatcgcccgccccgacgagatcgcatccgcggcgctgtttctggcgagcccgatggccagtttcgttaccggctcggccctgttcgccgacggaggcaatgcagccgtgaagtaaattcgcatcgccgcaaacgcgcgtcgcgccgtgctcaaccgccggcgcgaaccagcatgtcgatgaccgcgcgggtgcgcgagggccgggtgatctccgtccagtgcagatgcgcgtatttcgggtcgtcacgcgggccggcgaacttgacacgattcctggcgaacgtggtgtacgaccacagcagcaccgactctcgcgaaaatgccatccgcagcgactcgcggttgccgtgcgaaagttcggtgcgcatgagcccgcggctcaacgtgcgccagagcacccgggagaacaccgtccgccgcccgaagttgagccagatcacgtgagtggctctcgaccagagcacgtcgcgcacggcgctgtagttcccgtcggcgacccatcggtcgccggccgtcgcggccagcacggcgcgctcgaactgttccggcggcacggcagtccagtcggggccccagtagagtcgatccagctcgatgtacgggcagcccgcggccgccgccagtgcgctggaaaaggtggatttcccgctccgctggttccgacgacgacgacgcgcatgggtttgatcgcggttgaatgttgaagccgggtattgtgcctcatgcacgaagcggtcgctcgactgccgaggttcgtcgtcgaacctcggccatggtccggcttggtccgcgacactccctgcaatcgcgagccgggccgggtatccttgccgctccgcaacggccatttgaattcggcagcgacgtcgaccattcgctttccgcgcttttgcacaatcaaccgcttcagtcttgccgcactctgccgcggcaaacccgaaaaatcgagtggctgagcgacaacggttcaggctacacggctgacgacacgcgtcggttcgcagcggccatcggcctgaagcccttgaccacgccggtgtgcagcccacaaagtaacgggatggccgagagcttcgtgaagacgatgaaacgcgactacgtcgccttcatgccgaagccggacgcagcgactgccgcacgcaacctggccatcgcgttcgagcattacaacgagaagcatccccatagcgcgctgaaataccgctcgcctcgcgcgttccggcgctcgatggattcggcaaccttagtgtgatgctgtgtccgctattactggggcaactccacggcgaccacgtctaccagtccttcaatctcgtctctagccaggtccgtcacaccagattcatgccaaccccgatagcgccaaaggccgccactacgacccttggcgcttaacacctcactcgaaagctcacatcgcttcccatgatctgcaagtcttcaatttcaagtcgcccctcttgcggaagtgggccaaccaaattcaacccaactaacggggttgggcgcgtactgatagaagttcagtccgccttgcagcccaatcgggtccttgctgacgaagcggcctgtttgcggatcatagtaccgatgccggttatagtgcagccccgtctcatcgtcatgatgactggcccgcaagcaacgcagattctacttacgcatcaacatttccctgagtctcctaatctccgcaaccagcagtggtatatcttgtctagcatgcgcaataaaatcttgatccgcgatggtggcgccacttagctcgatatcgtcactgcgcccccttccggaccagtcatgatgaaatttgaaccgctttcatggtctcttccctcaacataagatacccacggccctggcgtagccgccttacagcgagcttcgatttcattgagtttttcatcgttcatattccacctactttcttgaatttggattgcggacagtcggcgtcatgagtgcctctgcgtgttccgctgttattcccgataaggttgcatgattcggattgttcctagttggcgatgcaaccacatcgccacctgccgccctaacattcccgaccgttgtaacaccgaccttcccatgcgggataccatcagtcagttcgtctagtgaccgtcccgtagcgctgtttaccgaaactccatcgagttttccgtctgcaccgacagtgacaccagatccctgacgaaacttctcgacagtacaactaccgcctctacatacaattgcctcgtcaggaagacggtcaggacaagggcatttttcttcgtcaatccaagtggatcaatccagcttatcggattcgacgcgtattgatagacattgatcccgccagccagtccaatcggatccttgctgatgaaccgtcccgaactgggatcgtagtaccgatgcctgttgtagtgcagccccgtctcgtggtcatagtactgcccttggaagcgtagcggattcgagaggatgccttgcccgacgcattccgaatggcctcctgtgccacgccccaagcgcgatactcggcgctccacgcaatctcgctctgctcgtccgtcagctccagcggcgtgccgagttgatcgcactggtaccacgccagtctgtcgatcggcggcgctggcggtggcggtagccacagcgggtcttcgtcctgccggtagtagtcgccgtagtcaggctggtcgagcagttcgatagcgtcatcgcgcaccgcctgcgccaccggcacgaagctgcccggctcgtagacatagtgcgtggtgcgcgcaccaaagccatcttcgtcggcgatcttgctttcccacgccagcgtatcgccgtcccagccgtacagcgtgaagccgcattgcagttcgcggttgcgcctcacccgctcgctgcggttccagtgcggccccgcctctcttctttcctcgtagtgggccttgctgtacttcgtcagacgccggccgagggcgtcgtagctgtagtccgcctgcaggcgctcgtcttcgtagtgcgtcagccggtcgaacaggtcccaggtatagcgactttccttgccctggtgccagcgcttgctgaggttgccccacgcgtcgtactggtagtgggtgccggcgtattgcttgagcaggttgtccagcgccttgatgcgcggcatgcgctggcgctcggcctcgcgctgttcggccggatcgatcaggttgctggcagggtcgaacgcgaaggtttcgtggcccaggcggctttgtgcctccagcagccggcccaccggatcgtagcggtaggccagttgaccgcgccgcgtgtcgttgatatcggtgagctggccgctggcgtcgtagcggtagcggcgcaccagcaggcggctgccgccagcggtctgcgtggccggccctttggcctcgtgggcaaatacctgctcgctcaaccgccccatggcatcccactgctgcttctgcagcaggcggttgccctgggtgcggacgatttcgcggtgcaggtcgtcgcgctcgtagctgaccagttcgcgctcgtccagttgcagggccagcaggtggccgctgccgtaggtgagccagctcaccctgtgcccgtccgggcgcacggtggcgatgcgctggttgagcgcgtcgtattcgtgctgccatacgccgaccagcggcttgccgaggcgggtgtagtgctggtgctcacgcaccaggttgccggccgcgtcgtggaaccattgcagtcggctgtcggcgttggtggccagcgccaggttgccgttgaggtcatacgcgaagcgttccacctgccagtcctgctcacgcggcggcgtctcgccggtttgcagcgccgcgcggcgttctgcaagacggcccatggcgtcgaaggtataggcggtgatgcgctgccagttcaccgcgcgcgccagcttgccggtttcttcctcgtactcgtagcgggtggtcgcgccatcaaagccggtttcggcgagtagtcgccctaccggatcgtagtgaaactcggcgtcgcggccgttctcgttgcgcagcgcggtgagctggccgagcttgtcccactggtagcgcagggtctggccggccgcgtccacccggctggcgagcagcccggcctcggtgtagtcccattcggtacgccgccccagggcatcgacgtgggtcagcaaacgcccttcggcatcgcgctcgaagtgttcttcgctgttgtcggggtggcggatgacggcgagctggccggcctcgtagcggtagcgggtgacgttgcccgccgcatctgtgaactgcacgagctggccgcgctcgtcgtaggcccattggctggccttggcggagcagtcgacgtagcgcgtgagctgcccattgacgttgtactcgagctgcttgatcttgccgctggcgtcggtgatgccgatcggcaggcccatcaggttgtacgcgtattcggtcttgttgcccagcgggtcaacgctctcggtcaggcggccgcgcgtgtcgtagtcgcgcagccagaggccgccctcggcatcgctgatcttgatcagttggctcttggtatcccaggcgtagtggagggtggtgccatcggcccggatgtgttcgagcaggttgctgttgtcgtcgtaggcgtaacggtcttcgctgccatcggtgtggacatggcggatgacgttcttggcgtcgtcgcggtagaaccactcggatcgtttgtccgggtggatgatgcggtaggtgtagccgaggatgtcgcaatagtgccaggtttcctgcccgtgcgcgtcggtgacgtaggtgaggcggatgttctcgtcccactccaggcgggtgtcgaagctgccgtcgtcggcccattcgcgcacggcgcgggcatcggagccggtgccctgccattcgagattcatgccgcggtcggtgcggtcggtgtagcgcgtgatcagatggtgccggtactggtaggtccagacggcggcgttctcgtcctgggcctgggtgagatcgcccgcctcgtcgtagcggtacacgctcagttggcgttgcaacgccgtgtcgtccagcaacctgactccggtgatgcggccgtgggcgtccacgttggtgcccaggtgggtatgcggctggctcgggtcgtcctggtaggtaacgaggtcggacagcaccacgcgctcgcccacgcggtggtcgtagccgagcagcaggccagcgccgccgcgcagctcgatccgcgtgagcaggtagcgatcgccataacgctggtaggtttcgcggcgctcgaagccacggcacagcaccagggtgctttcgcaggcgcgtatcagggtgaggttttcgatgcggtcttcatgcgctgcgccgaccttgggcagcgggtaatccaggctgcggccatcgtcgccgtggtagcgcaggccgtcgccaaccacgtcgaaacgcgtggtgtacggggtgatccagcgcgcgccgaattcgcccgcatcgtaggcccccaggctggagcggtaggtgcgtgtccagtcgatgggaaatggcccgggagcgtgaagtcggtatggctgagcgtctcgctgcccatggcgaagctgatgctgccgttggtcttggcgcacgtacagccttccttcagcagattggggtcctgtgtggtcgggtgttgcctgctctgcgcctcatgcatgttttcagagcccgtgcgtccaccctggctggtggtgtggggcttgacgttggcgccttgggtagcgccaccgcgagcgcgccagcgcgccaaggcggtgaccagggaagcgagcagatagccgatgctgttggccactttctcgtcgcccaggctggcgacctggcgcttgagttccggcgcgaaaatgcttaacgccttggtgttgcgaagcaccagttcacgctggcgctcgtcgagcagggttttggcggcaacgttggcggcggccttgccggtggctttatagacgctccacacggcgccaaggaaattgctgatgctggccttggggtcatgcagcaactggtcgccggcggcacgcatttgctccgccgctgccttggcgtcgccggaggcgttgagtttgctcttggcgagtgcttcgagaccgcctgcgatgtcgacaatcgccttctcgccccaatcgcccgcgtccttgagaatgccgttgagcttgccctgggcttcctgggcgaacttgtcgatctcgcccacgatgctggcattgaggtgggccaccagcacgttgacgagggcatcgccgagcagcgatttgccgttcagcttcagttcctggcgcaccaggaacagggttgggcgcaggctcatgcgcgccgctgccatggtcggcggcgccggcagcacgccgatgaggttgatgcccaggctgacccagtcgagcagcttgcgctccttggcctgcgccagggtgacgatatcgcccaggctgtcgaccagggcgatgatgttgccgaccacgggcagcgaccccgccacggtacggatgcggtcgagggtgaccacgccatcgctgactttgcgcagccactggtcgaactcttgggcgccgcggttgacgtcgcgcgcatcgacggtgttcagcggcgcgaccgccacctggggttcgcgttgttgttcctgcggcttcgggcttgccatgcgtgactcgtcgtgtaggttggcttgcacggcatgaccacggccgtgctcggtgatgaataggtagtgcggggtgtaggcccaacacctcgggcacatcacggctgcaaccatcacggctgcaccttccaccgtggatcggggttcgctgcttgccagcgcctgatggcttcacgggtggcgcctggctgggccgtggcaaagcttggcgcggcccgttgagcggtaagcgcatcttccaggagtgcctccagataggtgctacgcgaaacgctgcgggcctccacgggcacggcgggccacacggacgagccgacataggtgctttctgcccaggggtcggccgggtcgttaccgaaacgattggcgtcggtgttcttgagcagcaagcgcgtttcgttcatggattgactcctcgatgtcgtgcacttcgtcagccgtggttgctcaacgtaacgtcggcgttcttgatgccctggccatcgcgctgtccgtgatgaaccgacggccaggatcggatacgggcgcggcgccagcggtcaacgctttggccagggccgggtggtcccggccagcgcggtagcgttggcgatggacttggccagggccggtttcagggcctgcgtcaaggccggcaagtgcgcgggtagcttgggcagcgacgacatggcgtcggcgataagggactgggcctggtcggtgaggtgacgaagcggctccactggccacttgggcacgccgacatagctggcctccgaccaggggtcggcggggtcaagcccaaaacgaatctttgccggccccggcgccacgccggagaccacgttgcggcccgctgaatcgagcgtgcccttgaagactttgccgagcgcgtcctcgacttcgaaaccgccgttcgccaggccacgctggttggcgtaacgattgaagagctcgagattgccctggctgggcttgggcggctccggaaagctggtcgcccggctcttgggccccgtgtagctgaacttggccgcatggcccgtgtagcgcccgctggtctggtgggtgatgccgcccgcgttgtacaccgtggcgctgccgccgccgttgatgaccagctcggtcttggcgttcagcgtgatgcgctcggcggtgtgcgtgatgttgagcttggccagcaggttgatgctgtccttcagcgcgcggatgtcgatgtctcccgccgcggctaccaggcgatagcccatgctctgcacgaacaggcggatgccacggctggcactggcgagcaggcgcttgccgctggtcaggctgatgtgctccgtactgctgagcgcgatgtgttcgccgctggcgatatgggtcgagcccggcgtgctggtggcgatacccaccgggctggcgacgacgacgtacggctgcgcgaactcggggaagttgttgctggccgggtcgccggggccgttgccgacgatgccctggtgctgcttttgcagcgccttggcgaccgcatcctggtcacccgcctcctgcgcctgtacttcgcgggcctgggtgccgaagccctcctgctgctcgccggccacgtgcagacgggcggcggtttccttgaggtccttgtggtgctcgctggcgtgcggacgcggctcggtggtcagcagcaggccggagccggcacgcaccgcgccgtgctcgtcggtgcgcagctcgaagcccttgccgcgcgccttgccgccgcccgggcgcgggtggaccaggtagcccaggttgagcgcactggcaccctggtcgctgcgcagcgtggtgctgatctcgccgttggtgtcgtcgaacagcagttcgttgttgcgtccggccttgtgctccttgctcttgatggtgctgaggatgttgtgcttgggcagctcgtacggcggccgctgcagcgccatgtacgttctgccgatgaccagaggctggtcgcaatcgccgtcgatattgcccaccaggacttcctggccgatacgcgggatggccatgtggccccaggtggcgccggcccagttctgcgaaacacggatccagcaggagctgtgctcgtcggacttgccctgccggtcccaggtgaactggaccttgaccctgccccactcgtcgcagtggatttcctcacccggcggcccgacgacgatggcgacttgcgggccgtcgatgcgcggcttggccatcggctgcgggcgccattccacatcgtcgggaatcagctcggcggtgtagctgtagtgggtgcccagttccgcgtctgcgctttcctcggcctggctggtgtgctgtacgccgcgatgcctgatgcgcaggggccgccagccacggttgaggtcggcgcgcggatggccggtgaggtcgaaggccaggccgggcaccaggcgcgcatcgtcgccttccacttcggcggtgcgcgcgtcgccgcgcagcccgagcaggcgggtccgggtgaagggccgccccgccgcgtcttccttgtagcggccggggaactggtagacctcgtagtcctggctctggtgatcgagctgcgcgccgtcgtgttgatgctcctgggtataggtcgggtgcttgaaggtgtagtcgcgctgggtctgccgcgcggtacgcacgcgctcgccgtagcgcaagcgccgcagcgccggcgtgggctggtcgccgcccggcgtggcgttgtattcgaccgggccgccgtcgatggcgccgaagatgtagagattgtctccatggaccaggcggtggctgtcatcggcaaaggcaaaagcgtagtagaagccttcttccgccgccagccgtgcgaggaaatgcaagtcgctgtcgcctgcctgcacgcagtactcgcgcggcaggtgcgtctcggtcaccaactgttcgtagtcggtgatctcgtgctccttgagcaccgccgacaggatgttcggcacgctctgccgctggaagatgcgccagtcggcgcacaaccctgcacgtgcgagcctgggttcgaccaccgcgcgatagcgggtgcggcgaaagccggttccccttgttcgaaatcgctgaccaggccgtggacgtagcgcacgggctggccggcgcgccagatggtgagctgcgcgggctggtcgagaacggccgcgaaatcgatcgacggatcggtgctggccaggtcgaccgacagcgtgaatggctggctcagtccttcttccagctcgaacgaaaccacatcgaactcgaggcccccgccttgaaggtgaagcgcatatcggattgtcttgccatcgatgctccaagtggctgagcacctacggttgctgccgctagggcagagtgggcagcaggctctcagcagagatggacgtacatggacttctctggacgccagcatgggcattgatcgatggtggggatatgagacgattctgaaaattcacgcggaaatccggcaacttgtatgaaattcaattcggcaattcagagcccgcacgtccatcggcccccaaccccatcagggccggccggctcgcccgtgaccgaagccggccaaaccggccccgcgccaacaataggcgccaagctaattcctattcccgctcgcccgtctgcaccgcctcagttggaatcggccgctacccattgcgatcaggacgcagtgctgacgcggctccgagcctacgggcttccctggcggttacctggaatgacgacgctctacacgaccgactacctcgactactcctgcattggcagcagacgatcaatgccgcatcgccctatgcccaaaggctgtcaaagggcagaaagggtgaaaagggcaaggaaatggggcgcaaggaaatggccttacccaaaaaataacgtgagagaaacgatggcgaccgaacccggatttcagacgcgcatgtacgcggatagcgcccgcgtcgggagcccgtcatgtgcgctcgaatgggtaacgaccgggtgcgcgttccgatcggatcgagggctggcatgagcgacaaacccgttcttgccgccggtgcgccgtgcgaacctgcggcgtcggctgcttccctgatggcgctggcgtgcctggtcgtattcatggcccaaatggcgacgacggtgtacctgccgtcgctgcctgtcgtcatgcgcgagttgaagatgacgcaaggcggtgccgagttatccatctccgcctatgtgatcggtgccgcgctgccggtgccattctggggcgctgccgcggaacgctggggccggcgcggcccgctgctgatttcgctgctgctgttcattggcagcagcctgctgctcgccggctgcacggtcgcaccggcgctgctcgtgttgcgcgccatccagggcatcggcggcggcggcgcggcgatcatcgcccgaatcatcgtccgcgacaactggcgcggcgacgaactggcgcgacgcctctccgtgttgtcgatcgccttcatcacggccttgggcggtggccagttcatcggcgggctcatcggccgatacagtcattggcaaacgggtttcgtgctgatggccgtcgtcgccgcgctggcgatcgcgctgtcgtacgcgttgccgttgaaggcggggagccgtgccgccaaaccgtcgggcctggccggtacttactggctcctgctgcggcgcccgggcttcctgtggccagcctgcgcgggcggattggggttcgcgacgaccgtcaccttgcaggaggtgagcccgttcgtgttccaggaacatttcaagctggccgtgacgagcttcggcagtatcggcctgctgctcggcgtggcctatttcagtggggcgatgctggtcaaccgtctcgtgagacggcatggcggcgcccggctgatgcatgccggtgccgcgttgcttgcgttcgcaaccacgttgatgctggtgtcgtggctgagcggcctgctgacccatttcaccggcctgtggatcttcatcgcgctgtattgcctggcgatcttcggccaggcggtgctgtttccgaacagcatggcgaccgccgtcagcgatgcgcatgaacacggcgcgcatgcgatggccttgtgcggcttcctgcagcagggactggcgggcatcgccgcgacggccgcggtgctgcagcaccatggcggcgcgtggacgctcgccgtattcgtgctgggggcgctgacgtggctggtggtgcaggtcaaggtgcggggcaggtaggcggccgacgtcgacggacggtccatcggccgtatgcatctctcgcgaaaacagcggcgtgcggccgcgcatccgcgtcacgctgcgcggatatgccgatacaagaggcagtgtgacgcgctcatgctgccggctgtgccgtgcggctcaaacgaaagattcgtagaaatcatgttctcgcgcgtcgttcgcgaggcttttactacgaattaaaaggcagtgtcatcaagggcgagaatcgtagggccattaaaaatcccggcggcgcgcccggaatggcaataatcaaaatcaatatttaataaagcaaatagcatctgccgcgctacctcgagcttcacatcttccattccgtccgacccgcgcctcgcacgcctttccctagtaacggcgggcccggcacgcgcattccgccgatgcggcgttgccgaaaccggcatcgcagccgacgagatcatttcagatttctcaccaaatcatgactcgattaacatcgccgacagaaaatattaacctgtcagaaaatatcttgtaattataaaaatgacctcctagcatccctctgcagttcgtgacatgtcctggatcaaagtctgtacttgatgcattcctcgaacatcacccatacataaccggggattacatgaagaaactgtctcgcctgctgtccatcaccgcgattaccgtcgcgagtctcagtgcttttgcccaggccggcgaccagtcggccacggtcgacaaggcactgcaactgatccagcagaacccgtccgccttcagtctggccgctggcggcgcagcacgcacgttgaagttcgcagggccgcaggcgagtgcgccgacggacggcgatcaattcgaggtgcgcgacgtgatcgtcgatcccgacggcaccgagcacgtgcgtttcgaccgtttctacgcgggcctgcccgtgatcggcggtgacgtggtcgtccattcgagcaaggggcagttgaagcaggcgagcgtgacccagctcgcgccgatcaatctcgccggcacgatcggcaaggtcggaaaccgctccgtgatacgcaacgcgcccgacatcggcaacgccagggtcaagcgcatcgcgaccgcgcgcttcaactcggacgtgcgccgcgtcgacgacgcggaactcgtggtgttcgcacgcgacgtcacgccgacgctggcctacgcggtgcgcgtatacggcaagtcgaacgacgtgcacggcgatgcggtgctgtactacgtcgacgcacgcacgggcgccgtgctcgatgcgcaggacctgatcaagaccgccgccgcgaccggcaccggccgctcgctgtactacggcaacctgacgctgaccaccgaccagaccggcacgaacgcataccggatgctcgatccgaatcgcggcggcggctctgtgtacgacggtcgcggactgatcgcggaggacgtcgagcaggcgaccgacctgccgatcttcacgagcagcacgaacgtgtggggcaacaacgcgaccaccgaccggcagaccgtcgccgccgacatcgattacggtctggcgttaacttgggattactacaagacgacgcacaaccgcaacggtatcttcaacgacgggcgcggcgtgaagagtttcgcgcacgtggtgttcgacaccggcagcggcacgaccggcgcgaacgcggcatggatgccgtcgcacatcatggtgtacggcgacggccagccgggcacgagcctgccgaagccggtcgtgtcggtcgacgtggccggacacgagatgagccacggcgtgaccgaggccacggcgaacctgaactattcgggcgacgcgggtgggctgaacgaagcgacttccgacattttcggcacgctcgtcaagtactacgcgaacaacccgaacgatcccggcaactacgtgatcggtgcgcgcgtggtgagcggcggcctgcgcaagatgtacaagcaggatctcgatggcaggtcgttcagctgttacccgtccggcggattctcgtggtcgaatccgcgccacgatccgcatttcacgtcgggcgtcggcaaccgccttttctacctgctggcggaaggcccgacggtgccgtcgaccgataccggcctgacgaaggcgaaactggtctgcaacggcgacacgaccttcaccgggttgggccgcgagaaagccggcaagatctggtaccggacgctgaccgtgtatctgaacgccaactccagctacccgaacgcgcggcgtgcatcgatccaggcggcgaacgacctgtacggcgcgaattcggccgaaagcgcgacggtcgctcgtgcttggagcgcggtcggggtgaattgatggcgtgtgtgccagtgcgttgaatgtccgaggatcgatcgcgtggcggcatttcgtgtcggagaacggagagccgatcgaggccacgcgacgcccgggcaaatgacggacgcgtgttgatcgaccgcctgcaattgcgggcggtcgatctctggaatccggtttttgtcccgccagccacctatcccgttcttcggcacttcgtgccgacatggttgcgcctgccgcaccttcctcgataaccgcgccgcgttccctggccatccgagacgaacccggaagaaacctgacggtgaagcgcggcggaatccggccgtatcacccatcgcccacacccgtcggtcgatcggcaaaccatcggccgatccttcgatatcccgccccgtctcgttccggcacttttcccagaaaaatatcttccgggcaatcgtttgcgtgccgcgcggcgttcagtttattcatcgcatgccgatatccggaaggcgcgcctgatcgaagcggcatcgccccgcggtttcgatcgggaacggcatccacgcatgcgacggatagggaagaaaggttttggcgacagttttagggtgcatcgttcaacggcacaatcactggctggtcctgcttgccgcgctgttgtgcggggccggctcgtgggtcaccgcgcgcctgttccagcgcacggtgaacacctccggcacgcagcggttcggctggcaggtgctgacggccatttcggccggcgtggcgatctggtgcacgcacttcatcgcgatgctcggcttcgatgccggcgcgcccgtgcaattcgacctgccgctcacgctcgtgtcgctgctcatcgcggtcggcggcagcacgatcggcttcgcgctgacgacctgccgcatcgtcaggatcgcgcccgcgctcggcggcgcgatcgtcggcgtcgcgatcgtgctgatgcattacaccggcatgctcgcgtggcgggtcgagggcatcgtgtcgtgggacatcggctacctggtcgcgtcggtgctgctggcgatgaccctcgcggcgctcgcgctgcacctcgcgctgcggccgtcgccgcacgcggtcaaccagatggccggcgtgctgtcgctcgcgatcctcgcgctgcatttcaccgggatgtccgcgctgcgcatcacgccgctgacgctcgacggcgcgtggaccgacgtgaacacgctgcgtccgctggcgctggcggtcgcgggtacgtcgctcgtgatcgtctgcacggggctcgtgagctacgtgatcgacagcaacgtgcgggccgaatcgctcgagcacctgcgccggctggcactgagcgacatgctgaccggcctgccgaaccgggcgagcttcaacgagcggctggacctcgaaatcgcgctggcgcaagagcagggcacgaagctcgcgctgatcggcatcgacctgaaccgcttcaaggaaatcaacgatctgcgcggccaccacgccggcgacgaggtgctgcgcatcctcgcgcggcgcatgtcgaacgtgctgcgcgaaggcgaattcgtcgcccgcatcggcggcgacgaattcgcggcgctctgccggatgggcgacgacacccgcctgatggacctgctcgaacggctcgagcccgcgctctacaagccggtcaggctggacgactacgaggtcgtgccgggcgcgagcttcggtgtggccatctacccggacgacgcagccaccaaggcgatcctcatcaacaacgcggacctcgcgatgtaccgtgcgaagggcagcgtcgcgcaatcgatctgcttctacgagccggcgatggacctgatcgtccgcgcgcgccgcagcctcgcggccgacctgcgccgcgcggtggccgacaaccagttgagcatccactaccaggtgcagacgtcgctgacgaccggcgagatccgcggctacgaggcgctgctgcgctggcagcatgcgacgctcggcacgataccgcccaccgagttcattccgctcgccgaggagaacggcgtgatcctggagatcggcgcgtgggtgctgcgcgaggcatgcgcgcgcggccacgtgggagccgccctatacggtctcggtgaacgtttcggccgtgcagttcatgcacgcggacctgacggcgctcgtggcggacgtgctcgaggaaaccggcctgccggcatcgcgcctgcagctggaactgacggaatcgacgatcttcgccggccgcgagcgcgcgctggatacgctgcggcagatcaaggcgctgggcgtgagcatcgcgctcgacgatttcggtaccggctattcgtcgctcgacacgctgcgctcgttcccgttcgaccgcatcaagctcgaccagtcgttcgtcgcggacgcggaagcgaaaccgcaggatcgcgcgatcatccgcgccgtgctcgcgctcggcaagagcctgggcattccgatcctggccgaaggcatcgagacgcgcgaccagctcgtgctgctggccgacgaaggctgcgacgaagcgcagggcttcctgctcggcaggcccgcaccactcaacgagattgtcggcagcgggcagatcgcgctgaccggcagcaaccgcgccagcgcgacggttcccgcgtccggatcggccgtcacggccgagctggatccgggcccgcgccggtaagcgacaacgccggatacggcaatccgaacgcaggttgcagcaggcaggctcacatgaaaacccactacgcacggatggtcagactggcaagcatcgcggcgccggcccggaacccggacctgctcgcggcgcaattccgggtattcgccggccagctaccggtgatgtacctgatcctcgtctcgagcacctggagcctcgccgtcacgcacctgcgcagcacgccgtggtggttgtcggtcgcgatgccggccgggatgacgctcgtgtcgctcgcgcggctgctgcactggcgccgcgcgcggctggtggagccgacgccggacaccgtgtcgcgtgcgctcacgatgacgaactggctggtgatcccgatcgcggtgacgttcaccctctgggcgctgctgctgttcccgtacggcgacgcgtggcaaaaggcccaggtcgcgttctacatggcgatcacggtgatcggctgcatcttcagcctgatgtacctgcgcacggccgcgctgatcgtggccgtgatcgtcaacgccgcgttcatcgcgttctttctttcgacgggccagccgacgctcgtcgccaccgcggtcaacatggctttcgtgtcggccgcgctgatcgccgtcatctcggtcaactaccggggcttcgtgcgcaccgtcgacgcgcaggccgaatcgcggatgcgcgagcaggcgcagacgcggctgatgcggatgatcgacgacatgccggtggccgtgatgacggccgacccggagacgttccgcatcaactacctgaacacggcgtcgcgaaacctgctgcgctcgatccagcatttgctgccgatccgcgcggacgatgcgctcggcgcgtcgatcgacttcttccatccgcacccgcagcaccagcgccgcctgctcgccgatccggcgaacctgccgcatcgcggccgcgtgcggctcgggccggaagtgctcgacctccaggtctcggcggtgcgcgatgccgaggggcgctacatcggcccgatgctgtcgtggtcgatcgtcacgcagcaggccgaggcggaagcgcgcatccaccagctcgcgcatcacgattcgctcaccggcctgccgaaccgcgcgaccttcctcgccgaattcgacacgagcctgcgccgctcggacaagacgctcgggctgctcttcatcgacctcgacggcttcaagctgatcaacgacgcatgcgggcattcggcgggcgacgaggtgctgcgccaggtcgcggaacgccttcgcgggcagtgcccggaagcgaggacgatgttcgggcgcatcggcggcgacgaattcgcggtgctgctgcgcgacaccgacgcggacggcgcgatgggcgcggccgcgcggctcgtcgacacgctcgtcgcgccctatgcgccgtcgcccgagcggcagttccgcatcggcgcatcgatcggctgcgtgctggcgccgcatcacggcaacgacgccggcgtgctgctgtcacgcgcggacatggcgctctatgcggccaagaaagccgggaaggggacgtaccggatgttctcgccggacatggaaacgagcgcgcaggagcggatcgcgctcgaatcgaagctgcgcgtcgcgctggacgagaaccaggggctgtacgtgttctaccagccgatcgtcgatgtccggactcgccaggtgacgacgcgcgaggccctgctgcgctggcatcacccgcgctccggctggatttcgccgggctacttcattccggtggccgagcgcggcggcctgatcgaccggctcggccgcttcgtgctcgaccatgcatgccgggaggcggcgcgctggccagacggcgcgcgcgtcgccgtgaacgtgtcggcggcgcagctcggccacggcacgatcgtgccggccttcgcggcggcgctggccggcgcgggcctcacgcccgaccggctggaaatcgaggtgacggaaaccgcgctgctgcatgacgagggcaaggcgatcgcggacctgcgcgcgctgcgttcgatgggcgtgcgcgtcgccctcgacgatttcggcacgggcttctcgtcgctcgcgcatctgcgcgcgtttccgttcgacaagatcaagatcgacggcagcttcgtgcgcgatgcgatctcgcgaccggactgcgcggccgtcgtgtgcgcggtggccgatctcggcaagcgcctcggtgtgacgaccgtcgcggaaggcgtcgagacggaggagcaactggcgtgcatcacggatgccggctgccgcgaggtgcagggcttcctgatcggcaagcccgcgccgggcgagcacgatgcgccggccattcgctggattgagcgggccgcgctggctgcgcagtcgacgggcaggcgggcgtgagcgacggcgacgcgaccggactgcgcgatacccggatcgattgaaggccgaaaacgtgcattccgggatgacgattgcgtgcgccgggcgggttgcgttgcgggtcaggaatgcacgtccgcgatcacgcgtcgaacggcaaacgccagcggatcgacctcgtgcaccccgatgctgagtctcgcatcgaacgacgccgcaagctgctcgagttgaccgaaagcgtatccggggtccgcggtgacgatggtcacgaaggccataccccggcgatatcccgccttgacatcgatgcgaacgccgcccggaaagcgctggtgaagcgcttcgcgaaccaggccgatatcgatctcgccgggttccgcgcgccggcctttccgaggggtgacatcacgcacgaaaaacaggcgctgacgcgcacttccgggccgtcgatggcgccgacatgcgcaccttgccgataggcgagcaccgcgagccgcttgcgccgctcgattcccgataccaggacacacgtgccggcgacgttggtctggccttccgcgatcatttgcgcgaatcgaaccgcccgctcgccggaatcctcacgcgagccgaaatgcagcgcaagccttggcgttctaccgatttccgcgccgagccgcttcttgaccgacagcatggccgcgtcgtcgatgtcgtcgaacacgagttccgcggcgagcgggcgaccggcggaatagccggtgagcagttgccggatctcgacgagttcacctggcgcgccgtcaccctgcagctcgagcgtgacgaggacgacctctccatgcagccaggtcctggcggcgggatggggcttccgggcggccagatcgcgtgcgtcatccgcgcctgacgcacgcaccgcggccagcaggaacacgtcgtgggcgtggatgccgccgggcaccacgtatgcgcctttcttccaggccagcgcacgcaattccggaaacaggtcgtctgcctcgtatcccgtcgcgatcaccgagcggccgatcgccgccagctcgcgaggcgaccctccgcccgacaagcccggccccgcgaccgcttcttccttgaacaggcgcttccactcggacgaatactcggcatcgggcgcccatgacggcagcagttgtgcgaggtaggcgtccgcatccgcgatggtctcgaatttcgcgaccatcacgcactcaccgctgttgttgccggagaaggcctgccacacgctgaccggcggcgttgaccgggttcgaccggcatctgcgccgcgacgtgcacaaccgcgccgcgcactgggctgctcgagatgcgcacgcgcgttgcgccacccgtgcaggatgtcctccgcactggcggcaggcaggccgccgtcctgaaacgaacagccctgcatgcgctgatcgggcgtgatggagacgaagtccagccccgcgccgcagtcgccactgccgtcggcaccgtcgaacaatctggatacgggcaccgcgtcgccgaagcacaccgacaggcggcaggcgatcggcgaatcctgcacgatggccgcgagctgcgcgcgcccctcggcgaaaggtgcctgcgcaaatcggggccgatgtaggacagcaacgagacatcctgacaacccagcgcggccagttcggccagcagggcgggaggcccggcagcacggcgtcgtcgacgatcaggttggcgccccacctctgcccgtattccgacaggaccgtgcccgcgtcgtgccagcgcacgtcgtcgtagagcgagacgcggacctggccgaagcggcccgcgtagggcgcgaacgtgttgcgtcggatcagcgttccattggtcgtgacgttcagcgcaagcggcgtggtgtgatggaggatgtcgatcagctcggcgaatccacggaacgcgaacggctctccgccgccgaaggcgacttccagcgtgcctgccgcggcgaggccgcgaaggacaccggcggccgactggacggaccaggcgctgtcgcgccgcacatcacgcgagcagaagtcgcaggacagattgcacttgttcgttatcccgaacattacgacccggggtgcgaggcgccgcaagtggcgggtcgccgcgttctcgatccggacgtgcgttcctgtcgcggggtgaaagcgcagcagcgcgccgtccagcggatacgccctgaatgcattgcggtcaaaaccagtggaaaccggcatcggcgaggccctctgtctttttgtcgaggatccccgtgaacccggtggcagcacgggaaaccgtcatatttgaagcaactcgcgcagtcaccatccgttgcccggccgggcatgaatggcaggcgcggggaatggcgcaaggcgcttcacgctcggggagaaagaaatcctcgagcgcgtcgcgcccgaaagggaaatcatcccggcgtgcagccggcagccgacacgcgcggccgccgtagagtcgcaccgattataacggcggcccgatcacggcccggcctgcgaggtcagatgcggtcaaagtcgaacggcgtcacgtccggcaggccttcgacccgttgtacctcgacgctgcgcccagtgcggagcgtgtcgatcgtgcggcgcgcctcgagtgccttctttgaaacgacccatcaagccggacggcaagcggatcgcggagaagtgaactgcgatgcttgctcgaggtcattgcggtgcatgcgcagccgccgtaggatggcgggagacgtgcgtttcacatcacgtcatcttggcgacatctttctcacgtacatctattgcacttcgccagttggcggggtgccgatttttcaaggaagaccgaccatggcggcaaaacgctttcgcatcaacatgattacccgtcgccagtcgacgttcgacggccgtcatctcgacactgaggcggtacgccgctacgacgcgcaagtgcaagacgcgattcccgcccaattgaaaggcacgcagggtgccgaggcggaatggctgccgcgcgtgaaggtaagcgagcggtaatccggatacaccgattccgccgtccggccgcacgccctgtttcgatcgatgtgaaacgcgcccgccgtccggcgggcgcatgatgacgcgcgacgcacgcgtctcctcgttcgcgaattactggctggtggccagctccgctgcggggaccttcacgacgggccgcagaccgatcacgagcggacgtgcctcagtggacagcgcgctcacgtcgccgcgattggcgcgcacgatcaggcccgccaccgcattcagtgcgctcatgaacgcgccttcgagccagccgccgaggtggctgtagctgtcgctggcaatgaagaagcggttgtcgagcgacgcggcgagcgcatgcgtgtgataccggaagcacaggttgctctggtgatggtcgcccgtcatgtcgagcttgaagccgccggctgtcttgttggtcgtccagtcgaagacaaagcggtccgccgtgcgtgcttccgcgagcaactgatagaaccaccacggttgtgcgttcgacgcgcccgcatacttcacgtaccgatacgcgcgattcaccatcgtccggtacatcccgtccgccgtaccggtctcggttgccgggttttgcggatacaacccgaaatcgtgctgaagccgggtcgaatcgtcctcccacgtgtagctggccagcaggctcgaatactcgggcgcctggccgtcttcgacgatggggctcggtaccacgtagctcgccgcgaggccgctgtcggagacgacggccttgatcggttcgccgcgccattgcggaacccacggctggtcgagcgcggcggtcttgacggtggcgaacaccttcgacgagcgcgccatgtgaagctggccgatcgccgtgacgatccgggcgttcgcggcggggctgctatcgctcagcagcagcggcggatagacctggttgtacgtatgcgtttcgaggcccaggcccgcgtccccagattctggctggcggcatgttcgaagccgctgcggctgacgatcggcgtcaactgatcgtgcgggacggcgaggatcacgaaatcgtaggcttcggaatggacggcgttatggctgtcgtatgacagcagttgcgcgcgcgccgacgcggtgccggaatgacaggcgttcgcgacgcgttcctgacgaacctggacgaccagcttgccggcgccgacgtcctgggccttgaggaacagattccggatgaactcgacgttttccgtgaccggcagcgtgtattcgttcgaatagtcccagaggatcagccgcatcatctcgaccagcgagatgttgtacagcggcttgaagccgccggtgccgaagccgaagcggccgaacagttcgacgtagtagctgatcgattcatcgacgtcgagcacaccgtcgaccggcggcagcgttcccttctcgaacgcaaccgtcacgatctcgcggacggccgcaccgagcgtcaggccatcgtattgcgcgatgaactcgggccagtacttcgtctgaatccgctcgagggcatcggccggcggcgtagccgcattcaggatcgccgcgatcttggccggatccacattggcgatcggatacatcgcgacattctcgccttgcgggttgcccaccagcccgccggcgacgacacccagtaccttcaacgtcggcgaatccggatcttcccagtctttcggatcgctcccgacataacgatcgacccgattgccgaacacgaattcggtcggcaccttgcccggattcggaaataccttgatcggtgccgcgtccccgaatgcggcggacgcataatgccaggtcaatccggcgatttccggaaagcgcatcgcgcctacttcgtaaatggtgtcgccgctggcggatcgccgttgtgaacgagtgccgccgacactcgtccggccttgagcccgcgtaccttgatcgccttgattcccgggcggtcatgaagaaacgaatcgggatcggcttcgtagatctgcacgtcgatgccgcttcctgccggcagcgtcgccgcgagccggcccagttcgtagagtgcggcgatgccgcctgctccgccgccgacgatggcgatcctgtagttgccggcgggcagtgtacccaacggctcggcggcggcgaccggataggacaccagcgcggaatcgggatgccggtagttgatcccgctcaaccgggcttcgccaacggtggtggcaatcttcttctcgtccttcaggccgagcaggcggggaatgacggtaacgcccatgacgtttctccatcgagtgagtggaaaccgcgcgatatcgatcccgcttgccgctggcacagcgcgtcgggaccgattcaggacaacgacaacgcattgcgaacgaagcttgcgcagtatgcgaatgcggtttcgccaaatcaatcaatttttgtttgagaaacgatcgaggagaatgagcgaaatgatggaaaagaggcgggcttgggaaaggggatttcgtggcggtaaaagtcacgggatcccgatcgaatcgtcgatcatcttcggattgccgaacacgcgaccggtgaagcgtgcgatcagctgcgcaagcaccgccgacgggcgacgcctgcctcgacatcctcgaaaatgcgcctcccgtgctcgatgaaccgggaggcgcctcgccagcctgacagagccgtcaaaggtccgaccgcacgcaacggtcagttcgacatcccgaatcgcggatcgatatacgcatcgacgttctgcgactgcttgtacacgccgttgcgcacgttgaacgcattcgcgttgcgcgtcgagccgtagatcgaatcgagaccgtcgcccttgcggaacgcacgcttcgcggcggcttcgtcgagcaggtgcgtgcctttcagcagcgggaggtattgctccggcgtgagcccgacgcgcgcggacatgatcctgaccgcatctgcctgcgtcttcgggtcattgatgtacgcgacgcagcggtaccacaccttgatcaccttggcccagtcggcccggcgcgcggcgaggctcgcgggcgcgaccgtgatcgcatcgtagatcagccccggcgcgtcggccgacgtgaagatcgcgcgtgcgcccggtgcgcgcttcaacgcctcgtttgcgttcggctgccatgcggcgacagcggcgacatcggtcgacgagccgagcacctgcggcagttcgttggttttcgcattgaccagcgtcacgtcgccatccttcaatccgtgctttgcagcgcggtttcgagcaacaggtgatcgacgaggccgagctcgacgccgaccttcttgcccttcagcccctcgacgctgcgcagcggcggcttcgcgatgatcatgtcgttaccggcggaatagtcggtcagcaggatcatcacgttcttcgcgccggatgcgcccgtcacgagcgcatcgccgttggttgccgcgaccgcgtcgagcttgcccgcggaaaacgcgtcgagcgacgccgagtaatcgaaccattcgaaatcgacgtcgacgccggcctctttgaaccagcccttgtcgagcgcgacctggaacgcgacccagccgggccagtcgctgtagccgatcttcagcggcgccgccgcgtgaacggcgggcgccgcgagcagcgccgcggccgtggcggcggcaccccatgcacgacgggcggaacggaaggacagcaggcggcggagtgccgaggcgggacgggtcatcgtgtttctccaggagaccgggatcgggatcgtcgatacggaccgtgcaggagcacggtccggctgcgtagccggttcctgcggatgcggaacgaacgaagcggccacggagaggcgcgatggccgttgccatcgccagtctcccgggcttttgtcccgccgtgtagcgcgtgcgcgtccgctcgcgatcggacgaacccgtgccgggctgctctcggaccagacgttcgatgaaccggaaccctagcatccctaagatgcgacgccgccgcacctctcggcgtcatgccgagcgagaaccgtgccaacgacgtgcgacgagggcggctcagcggcggcgcgcggcccgttgcagttcgatgaagcgggcggagaagagggctgtcagcgcacgccggagcaggtcgagcttgttcatgaacggttggatgtcgagtgaaggtgccgccatcgatgcaatgcccatgccattgcggatcgtgccgtgcatgcgcatgcgacacgcactgcgccggtgcgggatcgcgttcgcctggtgcgcggcacgcccgccgcgagggcacggggccgccgccatgtcgtgcacgcggcgcacgtgcgggccgccgcaccgcgttgtgcagccgtttcgtcgaggctggcacgcaactcgcttgatcgttgcccgagaggtgcgaagcaatttgcatcatcttcaggatcgctagggttccggtcatgcggcgttcgcgccgcacgatgcctggtccgagagcaatccggtcttgccttcgcctcgatacgaggcagcggcgaggctccacggagggataaaagcccgggaggtcgcgatgtcgttcggtcgccctctcacgccttttatccaaccgaccacggagccgccatgtcgccgagccccaagccgtcctcgccccactaccgcacgtcgcgtgggaaacgctgattcccgccgggacccactggtccggcatcctgcgccgcggcctcgcgctgcgcatcgtcgatgtcgaaggcggtgcgaacctgtccgccgtatttcatcgccaggaagacccgctcgaacgctacaacatggccgatacgctgaaggcgcagcacaccgcgcatctcacgcgcggccatgcgctgtacacggacatggggcgcgtgatcgcgtcgatcacggccgacacgctcggctggcacgacccgctcggcggcgtcggcgacgcgcgcctgttcgcacacaagtacggcacgacgacgtaccaggccgatcgcaacgcgatgatccgcaacggccgcgacagcctcgtgctcgaactcgcgaagtacgggctgtcggcgcgcgacctcgtcgcgaacgtcaatttcttcagcaagctcgagacggggacgacggcacgctcgatttcgtccccggccattcgacggccggcagtgccgtcgacctgcgcttcgagatgaacacgctcgcagcattctcgaccgcgccgcatccgctcgatccgcgcgcggactatgcgccgaagccggtgaagctgatcgcgtaccgcgcgtatccggcggacgccgccgctcccgaagacgatccgtgccggcgcgcgtgcgccgagaacatgcgcggcttcaccaacaccgaccgcctgttcgcgtaaggagccgcaccatgccgatcatcgaaagccgcctcgacccgcgcgacgcgatccacgacatcacgctgaacgcgggcgaaccgtggctgcacgacctgaagcgcgggcaggtcttccgcatcctcgacctcgagggcaaccaggccgtcgacacgctgttctaccggtccgacgaccccgaggagcgctacagcgcacaggacacgatccgcgcgcagcgcaacctgtacctgagcgccggcagcgtgctgctgtcgagccggggcaacgcgatggcgacgatcgtcgccgatacgtgcgggcgtcacgacacgctcggcggcgcatgcgcggccgagagcaacacggtgcgctatgcgctcgacaagcggcacatgcacaactgccgcgacagcttcctcaatgcaatcgcgcactgcacgtgcggcacgggcgcgcggctcaccaagcgcgacctcgtcggcaacgtcaacttcttcatgaacgtacccgtcacgccgctcggcgggctgacgttcgaggacggcatttccgcgcccggcaagtacgtcgagatgcgcgcggagatggacatcaccgtgctgatctcgaactgcccgcaactgaacaacccgtgcaacggctacaacccgacgcccgtgcgtctcaccgtgtgggaggccgaatgagattcgccaaagtcctcgttgcgaaccgcggcgaaatcgcgtgccgcgtgatccggacgctgaagcggctcggcatcgcgtcggtcgcgatctactcggacgccgaccgcgacgcgcgtcacgtgacgctcgccgacgaagccgtgcggatcggccccgcgccggcgtcggagagctacctgaacgtcgcggcgatcctcgcagccgcgcgcgagacgggcgcgcaggccgtgcatcccggctacggcttcctgtccgagcatgccggtttcgccgatgcatgcgaagcggccggcgtgcgcttcatcgggccgcgcggcgaccagatgcgcgcgttcggcctcaagcacaccgcgcgcgcgctcgcggccgcacagggtgtcgcgctgctgccgggcacgggcctgctcgacgacgtggcgacggcgctcgccgaagccgatgcgatcggctatccggtgatgctgaagagtacagccggcggtggcgggatcggcatgtcgttgtgccgtgacgccgcgcagctcgaggcggccttcgaatccgtcgtgcggctcggcaacgcgaacttcgcgcatgcgggcgtgtatctcgagaaattcgtcgagcacgcgcggcatatcgaagtgcagatcttcggcgatggccgcggcggcgcgatcgcgctcggcgaacgcgattgctccgtgcagcgccgtaaccagaaggtgatcgaggagacacccgcgccggacctgaccgatgccgagcgcgacacgctgcacgcgagcgcggtgcggctcgcccgcgcggtcggctacgcgtcggccggcacggtcgagttcgtgttcgacgcgaacgcgcgccgcttctatttcctggaagtgaacacgcggttgcaggtcgaacattgcgtgaccgaagcggtcaccggcatcgatctcgtggaatggatgatcctgcaggccgaaggcgacctgccgccgctcgacacgctcgccgtcgcgccgcgcggcgcgagcatcaagtgcggctctatgcggaagatccgcacaagcagttccagccgagtgccggcgtgctcacgcatgtcgcctttccggacgacgtgcgcgtcgacggctggatcgacgcgggcaccgaggtcagcgcgcattacgatccgttgctcgcgaagctgatcgtgcgcggcgatacgcgccgcgacgcgctggcggcactgcaggccgcgctggcgcggaccgagctgtacgggatcgaaaccaacctcgactacctgcgcgcgattgccggctcggacacgttcgcgcgcggcgcgccgacgacggcgttcctgtcgcgcttcgcattcgcgccgcacacgatcgacgtgctcgacggcggcgtgcagaccaccgtgcagcaggcgcccgggcgagtcggttactggagcgtcggcgtgccgccgtccggtccgatggacgatcgcgcgttcgatctggccaacgcgctgctcggcaacgcacgcgacgcggccgggctggaattcacgatggtcggcgcgacgctgcgcttcaacaccgcgacgctgttcgtgctcggcggtgcgccgctcgcggcaacgctcgacggcgagcccgcgccgttctggcaggtgctgcgcgctcgaccgggctcggtactgaagctcggcggcgtgacgggcgcgggcgtgcgcgcgtgcctggccgtgaaaggcgggctgcaggtgcccgactatctcggcagcaaggccaccttcacgctcggccagttcggcggtcacgcggggcgcgcgctgcgcaagggcgacgtgctgcatctgcacgcggacgcggggcgcggcgacgccggcgcgacgctggccgacgacgacattcccgccttgacgcatgcgtggacgctcggtgtgctggacggaccgcacggcgcgccggacttcttcacgccggacgacatcgcgatgctctacggcacgcagtggacggtccactacaactcgagccgcaccggcgtccggctgctcggaccgaaaccgcaatgggcacgcgcggacggcggcgaggccggcctgcatccgtcgaacatccacgacaacgcgtatgcgatcggcgcggtcgatttcaccggcgacatgccggtgatcctcggcccgacggcccgagcctcggcggcttcgtgtgcccggtgacggtcgtgcgcgacgagctgtggaagctcgggcagttacggccgggcgataccgtgcagttcgtgcgcgcggccgctgcgatcgcgcaaccgacgcgcgacgtcgccactgctgcggccaccacgcccggcgaatgcgtgctgcatcgcgacccgtcggcgggcggcggcatcggtgtcgtctaccggcgctcgggcgatcgcaacgtgctggtcgaatacgggccgctcgtgctcgacttgaacctgcgctttcgcgtgcatgccctcatgtgctggctcgacgcgcaccggttacccggcatgctcgacctgacaccgggcatccgctcgcttcaggtgcagttcgatgcacgcgtgctgccgctcgatgcactgctcgcgcatctgcagaccgcggagcgggaactctccgacgtggccgacatgcgcgtgccgaaccgcatcgtgcatttgccgctgtcttgggacgacccgtcgacgcgcatcgcgatcgagcgctacatgcaatcggtgcggcccgatgcgccgtggtgtccgagcaatatcgagttcatccggcggatcaacgggctggcgagcatcgacgacgtgaagcgcatcgtgttcgacgcgcgttatctggtgatggggctcggcgatgtctacctcggtgcgccggtcgcgacgccgatcgatccgcggcaccggctcgtgacgaccaaatacaaccccgcgcgcacctggacacccgagaacgcggtcggcatcggcggcgcgtatctgtgcgtgtacggcatggaagggcccggcggctaccagttcgtcggccgtaccgtccagatgtggaaccgtcaccgcaccacgcgggagttcgaagccggcaagccgtggctgctgcgcttcttcgacgagatccgcttctacgaagtcagcgaggccgagctggctgcgctgcgcgcggatttcatcgcgggccgcgcgtcgctgaagatcgaggaatccgtgttcgacctgggcgcgtacaaccgcttcctgcgcgacgaggcggagtcgatcgcgacgttcaaggccgcgcagcaaaccgcgttcgaagccgagcgcgagcggtggcgggcggccgggcacgcggagtacgtcggcgaagcggagcagggcgacgcgcaggcggcgcgggaaacggccgcgctcgacgatacgcagcgcgcgattgccgcggacgtgtcgggcagcgtgtggaaggtgctggtcgaacccggcgagcgcgtgaccgaagggcaggtcgtcgcgatcgtcgaatcgatgaagatggaagtggcggtgacggcaatggaagacggcacgatcgagacaatcgattgcgcgccgggcgcggcggtcgtggccggccagcggctgatggtgcagaagaccggcgccgccgaggaggtggcatgagcacgacacaacgttcgccgctgcccgggccgggctcgatcgccgcgctgcgtgcgcgctacgaggcgggcaccctgacgccgcacgcgctcgtcgacgcgatcgccgcgcatttcgacgcgggcgatccgcatcatgcgtggatccggccgctgacgcacgccgagatgacgacctacgccgacgcgctggccggacgcgacatcgcgtcgctgccgctctacggcgtgccgttcgcgatcaaggacaacatcgacctcgccggcattccgacgacggcggcctgtccggcctatgcgtacacgccggatcgcagcgcgcccgtcgtcgagcgattgatcgcggccggcgcgattccggtcggcaagaccaatctcgaccagttcgcgaccgggctgtcggggcagcgctcgccgtacggcgcgtgccgcaatgcgctcgatccgcgctatgcgtcgggcgggtcgagttccgggtcggcggtggcggtcgcgctcggcgtcgcggcgttctcgctgggtaccgacacggccggctccgggcgcgtgccggcagcgtttcacgggctcgtcggaccaagccgacccgcggcgtgctgagtacgctcggcgtcgtgccggcttgccggtcgctcgattgcgtgtcggtgttcgcgcactcgccggccgacgcacggtcggtgttcgccgtcgcgcagggcgtgaccgaaggcgatccttacgggcgcgcatggcagccgctgccggatgtcgacccggtgcgttcgcttggccggtcgggtttcggcgtaccgcgtgccgatcagctcgaattcttcggcgacgaatcgtatcgcgcggcctgggaggtggcactcgaacgcctgcgggcgacgggcgcgcggatcgtcgagatcgatttcagcccgttcctggccgccgcgcggctgctctacgagggcccgtgggttgccgagcggcttgccgcactcggcgcattcgccgcgcgggagcccgatgcgctccatccggtgattcgcacgatcgtcggcggcgcgtcgcgcttcagcgcggccgacgcgttcgccgcgttcgaccggctcgcgacgctgcgcgtcgaggcgggccgcgcatgggccgggctcgacgcgatcgtgatgccgacctcggccacgaccgcgaccgtggacgcgctcgaagccgatccgatcggcatcaattcgcgcttcggctactacacgaacttcgtcaacctgctcgacctgtcggcgatcgcggtgcctgccggcgtctgcaagaccggggcgcacgcggggttgccgttcgggatcacgttcgtcggccgcgcgcacgacgatgcgcggctgctcgatctcgcgcaggcgtggggcgacggcgatcaggctgtccgtgaggccgggggcgctgcaacggcggacgcggcgccgacggaatccaccggcgtcgtgcgcgtggccgtcgtcggtgcgcatctgcgaggcgagccgttgaacgggcaactcacgcagcgacgcgcgcgtttcgtcgcggcgacgacgacggcggccacgtaccgtctctacgcgctgtccggcgcggcatccggcggcagcgtcgccaagccggggctcgtgcgcgtgccggaaggcggtgcgccgatcgcggtcgagatctgggagatgccggtcgacgcgtacggcagcttcgtcgcgggcattgcggcgccgctcggcatcggcacgctgacgctcgccgacgggtcgcgcgtgcagggcttcctgtgcgaaagcgcggcgctcgacgaggccacggacatcacgcgcttcggcggctggcgggcttaccgcgcccatgccgcgagcagcgcctcgcaatgaacgtccggtcgcgcgatgccacgggcgctgcgcgaccggcacccgaaacgatacggagatttccatgtcaatgacccgcaacacgaccggatggctggccgtgcgccgcgaactgacgacgcgcggcaaatggacgctcggcctggcgtccttcctgctgccgttcgccgtctggtgcctgatcagctatgtgccgttcgtctggcatccgcagatgcgcatcacgaatccgggaagcgtcgactatttccagaccggcatgcagatcgatcgcgacgtcttcgacgacgagctcgcgcatgcacgggagatgcatgcggccgtgccggagggcgtgcgcgcgaatccggtctacctgcccgcgccgcaccaggtgttgcgcgcgttctacaccgcattcacgaccccgcccgcatcccgcgacggcgtatggctgcacgagagcctgtggcacagcatccggatcattttctggggcttcgtgatctcgtccgcgatcggtgtgccgctcggcatcgtctgcggcaccttcagcgcgctcgcgagacttcaggagccgttcctggagttcttccgctacctgcccgcgccggccttcggcgcgctgatggtcgcgatcctgggcatctacgacgcaccgaagatcgcgatcatcgtgatcgggacgctgttccagcaggtgctgatcatcgcgaacacgacacgcaagctcgaatatgggctgttcgaggccgcgatgacgctcggcacgaagaagctcaagctgctcacccacgtcgtgattcccggtgtgctgccggacctgtatcgcgaccagcggatcctgctcggctgggcgtggacttacctgatcgttgccgaactcgtcggcaccagttcgggcatcacgtggtacatcagccagcaggcgcgctaccagcatttcgacaacgtgtatgcggcgatcctgatgatcggggtcatcggcctcgggaccgacatcgtgctcggggtgctcggccgcaagctgtttccgtgggaccgcacgctgaaagcgtgatgccctttgattcgcaaccatcaaccgatttccgcagagggcatcatgcagaatccgcaagccgttcccgagtacctgatgcagtccgacgcggtgcgcgagcgcttcgcacgactgaaaacccgcgacgtgatactcgacgtgcgccacgtcggcaagcgcttcgcgacgccgcagggcgagtgcgtcgcgctcgacgacatcagcttccgtacgcaccgccgcgaattcgtgtgcgtgatcggcccgtccggttgcggcaagtcgacgctgatccgcatcctggcggggctcgaagtgcagacaagcggcgaagtgctgctggacggcaagcccgtgcaggggccgggcgccgatcgcgggatggtgttccagggctatacgctgtttccgtggctcaccgtgaagaagaacgtgatgttcggtctccggatgaacgggagcagcagcggcgaggccgaacgcgaagcgctgcagtggctcgatctcgtcgggctgacgcgtttcgccgatgtgtatccgcaccagttgtccggcgggatgaagcagcgcgtggcgatcgcccgtgcgctggcgaaccgcccgcgcatcctgctgatggacgagccgttcggtgcgctcgacgcgcagacgcgtgcgcggatgcagacgcacctgctcgacatctggcgcaatatcgacgtgacgatcctgttcatcacgcacgatctcgatgaggcgattttcctggcggatcgcattctcgttctcaaggcgaatccggggcggtgcaggaactgatcgaggtgccggtgccacggccgcgcgattattcgcaggtcaattcgccggcgttcgtcgcgacgaaggcgcggctcgaagcgttgattcatccgaaggaggccgtgcctgccgatgacgacgacggtgtgaagccgcacatgatccggatgacggacgtgtcggacaacgtcgagtagaccgggaaggggaacggccgggcgatcggcacgggcgcggtcgggcgcgtgccggcggcgaggtgttcgggctccgtccacgtcggtagtcgtagccgacggcatgggtctggcgcgtctggtcttggccgcccgcgtcgcggccaagaccctgatcgagccgcatctggaggagttcggcacacgtttttccgcgctcggcctcgaactggtcatggacgacagcctggccaacatcgtggcggacggatgcgatgtcggcatccggatcggcgagagcctcgcgccgcacatgattgccgtctccatcacgccgtcactggagagggcggtggtcggcacgccggcgtatttcaggggccatggcgtacacgcgacgccggccgatcagcggcgccattcatccgtgcatcggacgactcgcgtttcatcggtcgcatgatccggatcggggatgatgcggatgaaatggacgccgcgcacgatagtgcatgcgccctggaagcgctcccgccggggtagccgaccggaaatgcgaagtccggcgtcggtgcaaaccgggttccgaaatccggccaggtaatacacgtctttcaccgcgacccgctggttaagctacggcaacaacagcaagtgctcggtggtgccagcctggccgagctgaatgtcggtcacgaccccgtcgacgcatggccgagcgctggaccgatcggtcagcgggtcggcggggccgtactcagcttctccgacagcatccgctcgtacacgccaaagtgcagatcgacctcctttgcgtgaccggggtgaccgtgatgttgatctggtcgggcaacaggcccagcacaaccgcaaccgcggcttcaagttgcggtgcacaaaccttgtcctccgccatcgtcgtgccgaccagcacgtcgtaggtctgttcgtgccggcagacgacctcgacgagtcgcgcccgcgcgctcatgttgttgtcgatcgcgagcctgacgacctcggtcacagtgcgcatcgtctcggtcggaaagcccttcgtcgagcgcagccggatacgatgcctgcccagcgtaagccagtccgtgtcgaattccatggcgtcctccgcatgcagttccaagccgctgcgatgataggttccagcaccagaatttcaagtgcaaaaatctgccgacgcaccttgaaatttttcgcagagtgcctatcttaggtttcgctcaggcagacgcgcgggcctccggatcccgcgcgctgcgtgtttcgatttgtttgccgacagtctggcaggcgaactggagcgcgtaggcccgttcgcctcccggctgcattcaaggaggatacgatcatgagcgatctttacttcggaaccgacctcttcagcgagttcgaccgcctgcagcagcagatggcgcaactcctcggcggcttcccgtccagcatccgcgctggccggcttggcgcgtttcctcagatcaatatcggtgcgaccgacgagtcgatcgagatcgtcgccttcgccccgggcatcaatgccgccgaactcgacgtatcgatcgacaagggcttgctgaccatcagcggcgaacgcaaatcgacacagcccggcactggcagcgagacgcgtacgtatgcgcaggagcgctttgccggcgccttcaggcgcgtcatcgagctgcccgacaccgccgatcccgacaaggtccaggcgcgctacgaaaatggctgtctgtcgatcagtgtcggcaggcgcgaatcgtccaagccgcgcgccatcactatccggtaatccgaggagccgatcatgaatgacacgacccaactggccgaacgcggcccgtccaccgtggcacgtcgcgacacggaacagcccaagcgccggatcacgctcgtcccggccgtcgacatatacgaggacagccaggtcgtcacgctatgggcggatctgcccggcgtgacgagggacaagctggacgtcaaggttcacgacaacagcctctcgatcgaggccgaggcggcggtgccgacgccggcaaatttgcggttgcagcatgccgaggtccgcgaaccgcatttcgcccggacgttcacgctgtcaccggacttcgatacgtcacggatagaggcgagccttcacgacggggtgctgaagctgacaatcccgcgccgcgacgaggcgcgcccacggcgcgttgaaatcaggaccagctgatccttcggcaacggcaggtcggcaaccagggcggcagcgatcgcgctgccgcctgcgcggaccaggagcagcgggggcgggtgtctgatgttacgcaggagtcctggaaaggacacgcgatcgatctccgcgccattcccgtgcgacggatcgtgacccgcctgtccgcactggagggctacatcgctatcgtccggatcgaacggaacgatgaggtgtcggccgaccggcatctgccgcgtttcagcaaacgctggacaagcgcgggcgaagcgcggcgcgatgcggtcgagtacgcggtgaaatcagattgaagctgaatcggaggacgccatgaataccgatttgaaaaagtggaaccccttcaagttccttcgcggaactgcccgcaagtccgatgcggaaggcgcggaaagcacgccgacaggcgaacagtggcgggcttcgtggcctgacatcccgcgattgttctcacgcgacccgtggcgtgcaatggaggcgttctttcacgacccgtttgcaggcggtggcgcgctcgaacgctggtttggcgacttcagctcgtcgcgcttccagccgcgcatcgacgtcgtcgatgaggggcaggtgctgcgcgtgaccgccgaactgcccggaatggagcgcgaagatctgaagttgagcgtcgaggatggagcaatcgtgctgcgtggagagaaaaagcaggatgtgcgcagcgaggaaaacggctgctaccggctggagcgcgcccatggaagcttcatgcgcacgatcccgatgccggaaaacgctgatcccgaccacaccctggcaaagtttgataacggtgtactcacgttgaccgtgccgaaatcggaaccggtgcagtccgccagtcgcacgatcgatatcggctagggcaagcacgccaagatcccgcatcgccgggcccgcttcgggtgcaacacgctgcaggaggtgtcatatgcaaacggacaacgtcatggagtatcacggctgcgaggtccggccggtggtaaccgtcaccggaaacagccgcttcgcggcagcggccattgtcaccgaccgggccggcgagacacgcacgctcggcgtcgatggcgatttcgccaacgcccaggaggctcgcgatgaagcgctggagcttgccgtcgcatggatccagcaacgctcggtcgtttcggagcggtatgtccggcggatctagcgtgccggtcgaaagccgagggccgggtgcgaagcaggcacctgcggaattgatgggcgattcgctcccggttccggtggctacggccggttagcgaccgtgaatacaagcgacgggaaagggtagggtcaataccgggccgataacgagagatgtcatgacgtcacggcttatgatagggaattgcgcttaccttgctcatgcccctgacagggcgcctcaatggattgcgggagcaaagagccgcgatcgtttttgatcaaacaatgagtcgagtcgacgattgagcacaaagccgctaaccctggaaaacgggaaatactgggcgacgtgtcgcgagcgaacggttttcgctgccacggcaaatggatatggtgacgtctttcccggtgcagaggtgatcgtcaaggacggatgggctacctttacccgtgacggcgtcgaagtgtggaactgcagtgcacgctatgcagccgcacacttcgacgttcagactgcttaggaaaatccgcacatgagccagcttgttcagattgcgcccggcgttgtgttctcatctgatgtgcttggcgtcgattgggcgcggaaatatcgacaggacgacggcgatgcgcagtccacggaccggcaggacctggcggtaagggaaagcgatcaggcaggtcgcacaagcatgccggctcagttgtcgttgttgtagagaaccgccgatcgcaggcaccggtttcttccgcgagtgagtgccgggcctgaccaaacgtcaacgggtagcgcgcacacgagcgcgaggtcgcgcttccgttcccaccgcctcttacgcgtctttcagccagggcatctccacgggtgacacgaccagttgccggaattcgcgtttcagatcgaagatgaacccgaccaggatcatggattcggcgtaaggaatcggaaagacgtgcggattttccggagtccgcaggggcgctcgggcgtgtcggcggtcgccgcggcgttctcgcgaacgctttccagttcttcagccatggccgggtcaccgactttcaacacacggttgcgcaggtcgctgaagggctcgatgcgcgcagcgtcttcgtggtattcgggtacttcgtaaacgaaccaggacattttcgtctcccatgagaaggggcgctattctaacgctgcccgaggatccaccgaaaatcggccatgtcgtgcgatggctgtgggcgctgcgaggaagtgggccttcgaggtgtgatcaccaatgcgtctccctgagtcacccgaaaaccgtcgcgaccatgaaccgatacatcgaatggcgctggaagcgcagcaaagtaacgacgcccgaccggagcaagtggcggggactatgcctgccgtgccgctcatcttgacgcacaagcgtacacgccacgagttgaacgtgaagcgtcccgtcaacgacgacggcgaaacgttcaaacatctcgcggtggacagccttcagcacgatgtaaccggactgtaccgcgccgctggtttcggtcgagggatttcaagccacccaagatgccggaccttcgcgaatcgccttattgcacagcgtcactcaatcgaaacggtgcagtcacttctcggccacatccatcttgatcatttcgctccatatctcaagatctcgaagaaggcgaggcgcaaggcgatggccgatctcgacggatttttcgctgatgcttgattgtcatccccgttggggatataagtccggaagtgactttgaccgttgaattgacgcatgactacgaaggaagatctcgcagcacttccccagcaggaactgctgcgcgtagcgatggatcgactgggtatgacgcgagcggagtttgccgcgcgcttgagcattgccgtgcggacgctggacaagtggcttctgccggcagactcgccagactcgcgcaccatgcccgatatgggccgatcatacgtgctggaaatcctgcagtggcagcaaatgcggaaacccgcttgattgtccccattggggatatatactgacgaatagtgaacctcgccttgagaagcaaatgccgaatcaaacttccgcgctgctgaacacgatcgacgccgacaaggcgacactcgacgccgcgcgtccgctgccacagcacaccgttgcctcgctgcgcgaaagttgttgctcgagtggacgtatcactcgaacgcgatcgagggcaacacgctgacgctgcgagaaaccaaggtggtgctcgaaggcatcacggtcggcggaaaatcccttcgcgagcacttcgaggcgacaaaccatcgtgacgcgatcgtctatgtcgaggacatcgtggcgaaagcggaggcactgtcggaatggcagattcgcaacatccacagtctcgtgttgaagggcatcgatgctgaagaagcgggccggtatcgccgcgaaaacgtggtgatcgcgggtgcgagtacaaccccgccggatttcatgcatctgcctgctgaaatggccgcgctgatcgactggtatgaggcggccggagacatgcatccggtcgagcgggcggcggaactgcacacgcgattcgtgaagatccatccgttcattgatggcaacgggcggacggggcggctgctgctcaacttcgagttgatgaaggccggctatccgcccgcgatcatccgcaaagaggatcggcttgcctactacgacgcgctcgacaaagcatgtgttagtggcgattacggcgacattacgcgactggttgccgaatctgcacaacgctcgcttgacacatatctcgacgtgctcgggctgcgtcatacacccgcaccggatacggctccgccgtcgccgggttttcggccgtaatcaaatatgaactggtttcagaagaatttataaggaaggaacccgttattgagcgtttggacgcgcagacgatctgcatttcgagtccttcgtctcggtatcggaaggggcgttcaacgacattctggatcagatatcgccctcatacagcaggtcctgagcggatcacgttctcgcgggcgacgacacgtgcaatacgcacgcgcagatcgagcacatcgaaatgtctggggcagaattcaccggtctcgccgtgcaagcgccgcgcggcgacacgcgcgtcacgggatcacgatcgaccgcgatgggcgccggccggaaacgtgctgccgacccatcgaggtcgcgcggggatagcagggagccttgattttgctgcgttttatcggcgtagatcgaaccagatccgccaaggcttaccacgcggcacctgaaacaatactcagcggtatcagtcgcttgctgaatggcccttccgcacttctgatacctgccctgaatgaatgtgccgcctgattggaatagtgggtggccctcggaatagggcgctattgaaacaaaagtccgcgccgccgataactgtcaacattgacagggattgcttcaattcgagttcttgccggctcgacgacagcaccacctgattgaagacaggcagatgattcctcaagcgtgacgccatttcgccaacgtgggcagctcgcgttcggtggccgtatcgtccagacgggtccagctgtaaaacgtgccgttccatcccggaacgggcaggggcgccgcgcatttgacgtcggcgaggcccggccgataggcctgcgatggccagaacagcggcatgatgctgcgcgcctccatgtcttggcgcaattcggccggaccgttcgcgtcggccacgatatcgcagtgaaacgaccaatcctcttcgttccaggcgagaaatacactcggcgcgcccgcggcgtcgaacatcagcaccgcgtcctgattggggcgccagtagtattcgacgatgccttcccgcgcggccacctcgtcgatcagtttgacgatcctcggatcccggtaggtcgaccctgcttcatgcaggctgatgtgcccgcgagccgcgcagtgcttgcgtttcgcgttgtccagcacggttgccagcttgcgtggcatctcgacgtcggttttcttcagaaagcaatcgatcagtcccgcgttgaacgcgtccaccgcctcgcgctcgtcggcgacgccggtgagcaggattttcatgcagtttgcgttgcggatggaggaaagaagctggatgccgtcgacctccggcattgaaaagtccacgaccaccgcgcccaccgcctcgaatcgggcgggatcggtgagcgcatcctcgccgatcgcattgccgcctttttctccgcaccgaaatagtccgcggccgttggcggcatctccacgtcacgcgacgacacgaagtcgagcgccacccggggttgcgtgaaaaagcggttcaggtgttcgtccggaaatgcgccccgcagtgcctgcaggaaatccggattgtcgtcgacaaacaccacggacacgggatagagcaccggctgcctgacgaaggtttgcatacgagtgtcgataaatcagcagaaaaagattcgataacggagacgcgtttccaaaaatgacggccgcgttgcatgaccgcgccaattatcgggcgaaagtgggatttacatcaaccatttgtcaaccactaatttggcatgtattgaccgaagcgctcaacagaattgcacggcgagaatctggccattccttctcgttgaaggaatgcgccgctaccgccagtagcgattcaaggagttttccatgttgacgcaagacgcgattcttcacgtcctttccaacgaaacggcacatcagtccgaaaaaccttccaccacgtggtcgacatttacctcaaggattccaatgccttcatgaatacctatttcgcacgctacttcgaatggcagggcgtgtgccgtgaacgctggtttcacgaatgcatccacaacaacctgctggcggccggcgggtcgttcgtgacgaagcgcgcgcatcaggaatacgtccaggagacgtttccgttccagcgggtcgactgcttcctcaatacgttcgaggtccggcagtgttcggcgtatctgctgtttcgcttctacgtcgacggacgacaggtgtcgctggggtaccagcagatcgtgtttgccgggcccgacaagcggatcagccggtttccggcgggcatcatcgagcgcgtcaaggcgtatgaactgatcctgccgtccgccgcgaactgaaggtgagactgccttacccgatgcgatagtgccgggtgggcgccggcggatcgcgcaacgcctggtccgccggcgaaccgggctccggcagccgaatcgtgaacgtcgtccgcacgccggggatggattcacacgcgatggcgccgccgagcgcttcgcatgcacgacgacagaagctcaatcccatgccggcgccgcacccgtgcgacttggtcgagaagaaggcgtcgaagatttgagggagcacctcgggagcgatgcccggacccgtgtcgctgaaacgcaccacgcagtaaccgttgctgcgatgagcgtcgatctcgatctgcccacggccgcttgcgtcgatcgcatacagggcgtttttcagcaggttgaagatgacgaagatcacgagcgagtcggttccggagaaccggaggtccggatcgatcgcgccgaccgacacgcggtcacgctccccggacggaaggaaagcgatccaccgcggcgtcgacacaggcccgaatcggataggccgcgaagccgtggcgatcgaggcggtccagcgtaaaggacgccagggacatttcgaccacggtgctcgtggtgtcgacctggcgccggatcgacgatgcgagcgtcggcagccggtccagctgccccggatacaagctgtcggcgcacaaccggtgctccaccgccagccgatacccgcgcagcagcgccggcaggacgttgcgcagctcgtccgcatgcaggccgatcgccgccagcggcgtggccacttcgtgcgcgaccgtcgcggccaggagataggggcccatcaggccatagcggacgatcgacgtcgcgagaatcccgagactcatcgcaatgaacaatacccccaccggatagaactcgacgccgtagttcaccgcgtagtcggtggccgcgagcgagtagaggcccaggctgacgagacattgcgtgagcagttgccggacatcccgcgcgcgcgtctgtcgtcgtgcctcgatcaggagccagccgctgcggccgaccaggaggacggtctgcacgacgtgcagcggatgcagtgggcccgccttgggatacggtccgaagaaatgcaggcggaatccatcgacgaccccattgcccgtgaccagcaatacggccagcagcacgcagaggccgtaggaggcgaacatgaacggccgctcgtcccgacgcgacacgatctccgtcacgaaatgatagaaggtcgtcggcaggaacaggatgaacagatagccagccttgaccagcaagttggcgacgtccgcgtcggtcgtctggaacaggaaggcccacgttccctgccagacgaaggtcgccgcgcacatcaaggcgaacgggacggatacccgcgtgaggcccttcgtggccagcacgtagaggccgaacccgagaaacaacgcagagacgaacgcgggcaagatcgagtacatgatgcgtgaatccacaatgttcactggtcgcgcaccactgtactgtcctggccggtgccggttgcgagagtagcacgcagcggcaggcgagcgagcgcgggcgggtttgtccacgagggtttcgcgcatctcgattgcggatcgtgcgcgtggcggatcctgaataggataatcgatcgccgtcgcgatcaggaactggtcatgggctaaaactttgccgcatgcgaaccgtgcattcacgattgcattcgttattgcgatcgcgcgaactatcgccgtgacaaatggcgggaaccgcgcagtaacaaacgctgcggccgatcgggtgaagcgggaattcgaacaatgcaacaatttgccgcagccaactgcccgatcagcggatgagccgtcgtcgattttcaagctatttttagaagcaatcgcgccgatcgaacacgaaatgcagaataatcgaccgacccgttacatctttccgggaacccgcgttccctgtcatggaaaaatgacgtcagccggatagcagatgcatgcttgcggtaaacaccgcgggctacgcattaacaccgagtttcgcgaatatttctcgatgctcgaaaatcgcacggattatcgaatcaaattcgatgcccatggctgcggcacggccatcatggaatcagcatgactttttgcggtccgcgacgtcctggatgaccttaaacctgtccaactcgcgcatcgtcatcgtgatccgttccagccatcgcagcctccggcgctggattcccagcggccgatcagcttacgatgggtcgaaaagcggatatttcaatctagccgctacaaaatcaaaaatgatcatcagcattatgtcaactaacaaccacacacttgaactgagcgctgcagaaatcgacgacctgaagaaggcaggatacaccgtccacacggttgtcgaccaagacccggtgctgtacggctggatgcacccaagttctaccgcatcgcaaagccactatacggaccggcagccgttccgaaagtcgcaagcccaagcatggttggactgttacgcatatcaccatggccatatgccaatgaaggctgagccggattggatggacaagccggcgtcgtaagcgtttgcaaattttcggtcggcgtcgcgccgttgcagcgcacccacgcgctccgattgcaccgaagtatcgcgatccgaaaaccggcgcgacgtggagtggccgcggtaaggcgccgcagtggattgcgaaagccaagaatcgcgatcgttttctgatcgaacagtgagccgagttgacagttgatcacgttgctcggcctctgtccgatgggagatactcggcaacgtgtcgtgagcgtacgatcgtcgcagcaacggcaaacggacatcgcgacgtatttccgtgcgcggagatgatcgtcacggatggatgggcaaccttcgatctgccgcgcgctgaaggacaagcagcaatgcgggccgaactacaacgaatcggtcgagaagtttttctaggtaacaacgactaggtcatacagcgagggtcaatatgagcgtgtttcctgatttcgcgcgggagattgccgacgcggcgcgagtgacttaccgcgcccttcttgcggcacatcccgacgaacatttttatgcttttgctctctacaccgacagtggcgcgatgaccgtcgtgccggccgccaatactgaggaggggttgaagcgggtccgcgaacagatggaaatcgatgacgacgaggatgctccggagttcacgtgggcgaccggcgaatgggcgtatgaagcagccgagtcggactcgttcaatcccttatgcaaaaggttggccgacacggtacttggtccgaactttccggaagcgaagtttcacgtctttttgaagatctccagagcgacatgatcgaagcgctgcgacttctcgatcaggaaggactgttcggaaccggtgcggagcgcgagaaaatcacgctgttcgtcacgatcagtgatgacgacgggtccgtggatctagagaacaaatcggccaaggtattgaacccgccttccgtgttcgatcgcttcatcaagcgctacgactagcagcggaaatacccatcagagacaccggccgcggattgagacgtgacaaggtcacgatgccgacgatcacttactgtctggcaggctgcacaagttcgtcggtttcacaaaagaaatctcgttgaccaggtgccggtcgagccagccgacgtgcagctcgcggtcgcgcatgccctgcccgcttcagcgcgcgcgagatcgcctgcaattgcgcccacaggtgctcggcgtccgcgaccgatagagtatctgcagcagcatctaatgcggcaacgatcatgtcgaattgctgggctgccgatgcaagaaccggtagggctcgcgcacgggcctgctcttcgcgatagacagccatccaacacgagagcgtctggcgttcggcgcggctcaacacctggagtagcatccgtggcaccggttcgtcgacgcgaaacgacccgactacacgacggacacaacgagcgccctcacgcgatcgcccgaccgcggcagatcctctcaacggttcgaggcgcaccaacttgactacgcgtccctgtttgcgaatcagcatggggattgtctgggtcacacgatcactgcagcagcatagcgcaaactttcgttacgatcgacgacgccacacgcgaggtaaagagcacgcttgggggcgtcgcacgaggtccgagaataaatcgggactgcttgccgtgcgaggttccctcgcttatatcgtactcgacacgacaccggaggtcatcgtgaacgtcccgctgttgatgccacgcctgttctgttcggccttcgagctgaccggcgcgatccacgatggcgaggtgttggtcgatacgcgccgggtttcgaagattcgtgggatgctgattgcgttctatggagcggatcctggcccttacgaggtcgctctcgcggccgtggcgacagacgtgttctcagacgaaaacacacgcgcctgtttccttgagagggtcgatgcgttcgaccgtctgctcgcgaatagaggtctaattgacgcgtggggcacacacggatgggtgcgacgcaacccgaccgatcaagatcggtttgcgcccgctctatttgtggtcgaggccgcggcgatctgtcctttgaacaccgatcgccgagcgttcgacctacgggattttcacgcagcggcgtacaaacgagccgccgcgcgaggtgtggagttttggtagccagggtggatcactcgaaccccatttcaagtgtgattgcttgcatggcgacgggaactcctgccgcaatctgcggttcagtcgacgcgccgcgtctagcaagactggcatccatcgatgcctcgaccggcaccacgtcggcacgaactggggccggccgcccagctcattcatctgccagggcacggcggtacacgcggctcaccgcacttcgagatcgacgcttgcctgcgggcgaaaagcaaggtcgccccctacacgggcacactcgaccacgtcgtcgcccctggtactcaataggcatccgacctccagcgtctccatgctgtcgatgtcgaaacacgcgatcgtaacgatcgacgggcccttcagccgcacgcggcttggtgaattcaattcgaacgtaagtgcgctggggcagcgcctcctgctgaggtggttcgacatggatcaagcagctgtagcacgcaggcgcccgcgtggattcgccgatcgctctgcagagcaaaacgcctcccattgctcaggtgtggctcggtcgatcttctcaatcgccacggtgcgcgcggcgtcgatcgacccttccatgatccttccaatgcttcgtcccgtttccacgtccgacaccgagaacagcgccggcgtgtacggatcggagagcgtgctgcgatgcacggcccaagtgcgaccacgatgttcgaacgggacaccgattgtttcgatccagcgatcttcatgcagcgcgacgtggaacacgattccatcgacgcgcaggggctccggcctggcgagtaccctttgttggtcttgtgagtcatcaggtcactcctaatcagcctggttgaggatctcaacattgaaaccggcgggccagccgtacgtacggacctgcagcgcgtcctccgcgatcaactcgggtatgacgtcccagtagtcttcatcggtcggtgtgatcatcacgattgcactcggcatacctcttgccgcagcgatctggccggctaggcgcttgagttctgcggtccaatcgcgaacctgctgctctaggatccgctgttcgtcatacgctttcgtcatcattttcctcatcgagtcactggttccgggatccccttgatttcggtgcagtttaccggtgtaagtcgatctagctgcgacaagagtttgcgctccgctccctaaaaatattctttataatcaattggatgatgattgctagcccaaagatcgctcttggctaagagacgcgaattgaatccatcaaattctcggcaatgcatctaatattttttgctttacctaaatttgtttacctgcaagtattgccctgcggttcgtaacgaactgcatcgagcctgaacgtttctttcggattgctttaatttttaatacatggagcttcagatgaagatcgaaaacaagatggtcatgaaaggtgcacaaagcaaaatcgtccacgcaattaccgctgccctgaagtgacagcagcgtagtgaattgtcaatggcggatcccggatccgccatatcggacagaggcgaccgatgaatcccatcgaacagaacggcgacctgcttcagatgttcaatccagacggcgtccggctggccaacgagaccgtgcggccggtatttcccgatctcgttgataaactggcttcggacatttatggatacgcgtatcgccgacccggcattgatctgaagacacggcacctcgtcacgctcggggtaatcagcgccatgggcggctgcgagaatcaattgcgttttcaacttggcgctgccctgcacctcggcataccgatcgaacaaattcgcgaggtatttattcaggtgcaagttttgccgggaacgcacgggcgttcaacgcggcagccattttcaaatccgttgccgacgagtttcagaagagcgaatagcgtgatgcactcgacccgatggcagctgatcgtgacttatgtgttagccgacgcagccgtgacggtttcgtcgcgcatcctgcaattctatgccacctggcttttgctgaaggacatcgcaagcccgtcggcactcacgctgacgctaatcgcgacgtgggcgacgaccttgctattccttccatttgtcggcgttgtcgccgagcgaatccgcaagagcaccgtgttgctgtgcgcgtcgctgctcgcacttgcatcggtgataccggtcgtcgtcgttgcacgtacgcttcacgtcacccactcgaattggcttgttgtcgttatcgtcatcgcaagcgtgacctcgagcgtcgccgtggcggccctgatgccgctgagcacaccgctgatacccgagatttcgcccgatgccgacgaggttcgcagaggtttgcgcctgaaggcgtcgggtttcatcctgaacatcctgttcggcccgacgttggcgggcttcatgatcggggcatttggcggcgagtccgcgctttggctgagtgccgcgagcagttgtctcggcgtcgtggcctcgctcgccttccacatgtcgttcagtgcggtgcaatcggtgcgaacgcgcgccgggccagcaccgtcgtttttccgggacctgcgccacgggatgcaacgggtactcggtattcgagccgagcgggcgatcgcgacagcgtcgctgctcgccaacatgctgttcgtcccgttcatattcttcctgttgccagccaaggttctcgcggagggcggcaccatgctgaacgtggccagcatcgagctgtcgttgggcgcgggcgtattgggggcttctgccctgctgatccagcaagcccggcgcatcgcttccgatcatgcagtttcgagcgtcggcatcggaatgatcggcgcctccatctttgcgttcgggttcacgcaccatctcctcacttggtgcgtgctgggtttcgcattgggtgtcgggttgacgacgttcaacgtcacagtcaattcgaaacgagcgatggcgattccggaagggcatcgcaccggcatggaatcgagcctgatgtttctttgcacggccgccgctcctttgggcatctggatatcgggcgtggccctcaagacactgtcgcccgacgccgtcatcatctacggcagcgaacttttcgtgcttgcactcctttgtatcgtcttttccaggccgttgaggctcatgctcaattccggagatagtggcttgcctcactatctccagactaaccgagaactgttcgaccttcaatcactgtcatgacctatccctttcttccggtggcaagtgtggcttcgtcgctgtcaacggggttcaaatcccaactgaagtccgcgtatgaggatctgctcgaacaactcgcggcacatgcgccggcgctgtttcccgacagcgtccacgcgcacttcgcaaccttgcagcccgccggattcaatggatttcacagcttcgcctaccactatgtgatccgcttggcggagcagaacaagctgccggaagcgtcgcgcctgctcacggtcatcgcgcgcgaccgatacgagacgctgcctcgattcacgccggcatcgcgcatcgattgcaagttgctacgcgaggtgctggacgaaatctcgggtggcacatcctatacggagattgtcttacggccgctgccccgggaaaggagcaactcgcggaagcggctatgacacacggcgttcgggtgcttgaagccgcgtatgcggaactcgccgcggagatcgagatcctcgtcggctcgatcgtctttttgaatcggcgggtgcgactagcgagcgtgcgttatcgctaacgggtgataagcttcaatcgatgattctcgtgaacggggagatcgacctgagttggatcttcctgctcgacaagctggttcatgaggcggcgcacacctacctatatggcatcaatttgcgcgaggaactcgttcaaaacagcccggaaataaagtatgcgtctccgctgcgtcgggatgcccgcgacatgcttgcgatctatcacgcgacgtttgtcatccaacgcctgctggttgcgtttacgcgcattcttgagcgtgcggcgctatctgatgccgatcgggtcacgatcaaggagatgctcgggctgtaccatgcccgactcgatgccggcttctcgacgatcgagcgttatggcgttttgtccaacgtcgcgcgggaattgatccatgaggggcgggattgtgcgaaatcgctggcgtcctgctgattgaggctgcgtgccaaagcgtaaatcgctatcacacggctcgcgctcaaccacgaagcacagtcgcggttcgagtgcacgtcctggtgcatgacgtttttgtaagacatcggcaattgccgaagtgcccaaatactctttgtctttcgtgcgcccgattgcttcacggatttttcccgctacgctgcatagtccgtttttcgtgcgggagtgcgagcgatggaccactggcggctggcgtatctcggcatgcgacacttcccgcatgagctgaccgaattcgagctcaataccttctttacgttctccgcccgcgagcgcaccttgatcgacggccgccgttcgcacctctaccgcttggcggtcgcgctgcacttgggcttcgtgcggatgaccggccgcacgctcgacgcttacaaacaaattccaaaacggctgtggcagcacttgggtgagcaactcggcatcgacccgcccgacttggggacgttgcgcgcgctgtacgacgaccgtactgacacgctagccgaccaccagaagctcacctacgaggcgctcggatttcaacccatggccgagcaccagcgacgctacgtcattcgctggctcaaggagcggctgtcgggccgacaggatcgcagcaccgcgctgtttgatctcaagcagtggctgtacgagcatcgggtcctgattgtccacgaccgtgcgctgcgacacctaatcgtgcaggcggtgcaggacgtcgaaacggcgctaactcaccggctcgaggctgcgttcggcgccgctgcccttgatcagtggggcatgctgttgccgcggccggaatcgggcggcgccagcctgcagcagtggctctggtccgtgccgctgcggaactcgacgaatcagatgggcgagttgtttcgcaagattgagcgcctgactaagctcggcgtgcatcgcgattggccggccgaatgcaacgaggccgtggtgcggcactacgcgcgacgctgcgccaaccgcccgccgtccgtcagcaagcgcgtccgacagccgattcgccgactggaggctgcgtgtttcatgcgttatgcgctctgcgtcgccaccgatcagttgctgtggatgcttgcccgctggcaacgcaagatggtcaacgaagcgggcagcaaggtcgacgcgaagcggcccgacctgaaagcgcagctacgcgatttcgcgacggcggtcaaggcgctcgcgaccgacgtcaccctggggctttgtcaagttagccgagtaagtacggagcgagcgtaagagtgacccgctgcgtcatgctgcagacggaatgggggacttcggcgaattcatgccacgtcgagaaacgtgcggcaaggtgtttgcgataaagagaggcgcgcagtagatgtcgcttcaaggcgaaatgctgacggatcggtccgaagctcgcgaggaaggcctgagttcgcttcgggtcgcgaaaccctcgcatgcgtcgctcgcgttcgcgggtgggttgatgcctgttctcaacacggttgttcacgcgcgcacaggccttcacgaacacgtgcttcacgttcgccagttccggtaactccgccttcgcagcaggataactgcgcagctgatcggtaacgatctttcgcggcgccggaaaggaatgcagcactcgctggaagaaacgtttggcggcagctttatcacgccgcttctgcagcaggatgtcgagttcggcaccatgctcgtcgacggcgcgccacagcacataaggctcgccgcgcagagtcacgaacatctcgccgaggtgccaggtgctgccggtcttgcgtcgtacagtcttcgcgcagcccgcgaagactgcaccgaatttgtcgcaccagcgacggatggtttcgtggctgacgatgacaccgcgttcgaacagcagttcctcaatgtcgcgcagactgagctggaaccggaagtaccatcggactgccaggctgatgatcgcagctgggaaacgatggccgtggtaaagcgatttgggattcgtcattccggcatcctacgcgatcaccctccgtaacgtgacaaagcccacatgtctacgaagtcacgctggcgctgggttcgagcgcagagtggctttcctctgccccgggccggatcttgaaccagatcgagtacatagctggcagaaacaccaacgtcagtatcgttccggcgaaagttcctccgatcagcgtataggccagcgtgccccagaacacggaatgggtcagcggaatgaacgcaagcatcgcggcaaccgcagtcaggatcacgggcctcgagcgctgcagggtggcctccactaccgcatcgaacggcgccatgcccgcacgcgtgttctcttcaatctggccgatcaggatcagcgtgttgcgcatcaggatgccggagagcgcaatgagccccaccaatgcgttgatgccgaagggctgattgaacagcaggagtgtcggcaccacgccgatcaaacccagcggactggtcgcgaacaccatcatggtcgcggcaatcgagcgcgtctggaaaatgatgatgagcagcgtcagcgcaatcatgatcgggaacagcggcgcgagcgcattggtcgccttgttggcctcctcgatggagccggcctcctcgatccggtagccgcccggcagcttcgcgatgatgggctgcaattgcgcgagcatcgcggtcgacacgtcgggcggttgcaatccttcggcgatatcgccacgcacggtaatcgtcggcgttcgatcgcggcggcgcaggatcggatcctccatgcggatgtcgaccttgccgacctgcgagagcggcacccgctgccctgcgttaccgatcagcgtgaatccctcgatccgttgcgggtcgagccgggtgtctcccgccgaacgcgcgaccagctccaccgaacgaatgtcctcgcgcacgtgcgtgacgggaattccggtcagcaggaattgcagttgctgcgcgaccgagctggacgtcagcccgaacgacccgagacgattttgatcgagcgtgaaatgcacggtgggaacgcgcggccccagtcggcgttcaccgttcgcatcatcgggctggccttcatggtccgctcgacctgcgcggcgatggtgcgcaatgtccccgcgtccgggcccatgaccctgaacgcaacggggtaaggcgagtaagggccgaacaccaactgcgtgacgcgaacctgcgccccgggcaccaatccttcggcgacgaccttgcgcagacggaatttgagcgcttctcgctggtgctcgtcgctcgtgcggatcacgatcttcgagaaggacgaatccggcagctccggggacatggccagatagaagcgcggcgcgccctgcccgatgtacgaggtcacgatctgcgcttccggctgcttcgcgagccacgcctcgaccttttccgttgccgacgcggtctgctcgatcgacgtcccatagggcatctgcacttcgacgagcacttccgggcgatcggacgtcgggaagaactgcttcttcaccaatcccatgcccatcacggcaaccacgaacgatgccaccacgatcccggcgaccatccacttgcgtccgatcacgcgtccgaggaaacggcgaaagcgctggtagctccgcgtgttgtagatcgcttcgtggccgccttcgatcacggcaatgtcgggtaacagcttgacgccgaggtacggtgtgaagacgacggccacgacccacgacgtgatcagcgcgatgccgacgatccagaacatgttgctcgtgtattcgccggccgtcgagcgcgcgaaaccgttcggcatgaagccgaccgccgtgaccagcgtgcccgacagcatcggcgcggccgtatggctccacgcgtaagccgacgcctggacgcggttgtagccctcttccattttcacgaccatcatttcgatggcgatgatcgcgtcgtcgacgagcaggcccagcgcgagaatcagcgaaccgagcgtgatgcggtcgaagctcttgcccgtggcggccatcacgacgaagacccccgcgagcgtcagcggcactgccgccgacacgacgatgccgacgcgccatcccatgctcgcgaagctcacgaccatcaccacgagcagcgcgacgaagaacttgaccatgaattcgtcgacggccgaatggatattgacggcctggtcggtcaccttcgtgaggctcatgcccagcggcatcccggcattgatcgatgcgacctccgcgtcgagcgcgttgccgaggttgagcccgttccagccgtcccgcatcacgacgccgagcagcaacgccggttcgccgttgttgcgaatctggaacgtggccgggtcttcgtacccgcgttcgacggtcgccacgtcggagagcttcaacgtgcggccctgaacgacgatcggcgtgtcacgaatggtctgcagcttgtcgaacgcgccttcgacacgaatgaagacctgcgcgcccgcagtatcgatcgaaccggccggcgtcagaacgttctggttgttcaacgcggcaaagatctcctggggcgtcacgccgagcgtcgcgagccggtcgtgcgaaaacgagacatagatccgttccgcctgctcgccgatgatgttcaccttcttgacgcccggcacatgaagaagccgctggcgcaatccctcggcgtcgcgcaccagcactcgttgcggctcgccttttgccttgagcgcgaacagcgcgaacgttacgtcggagtactcatcgttgacgagcgggccgatcacgccgggcggcaggttgcccgcttcgtcatgcagcttcttgcgcgcctgatagaactcctcgggcacgtccgcgggcggcgtactgtcgagcaaggtcaccgtggtgaaggccaaccctggacgcgtataggtctccgtccggtcgtaccagcgcagttcctgcatgcgcttttcgagcggctcggccacctggtcctgcatttcctgcgcggtcgcgccgggccatgccgtaatgaccgtcatcgacttgacggtaaagggcggatcttcggcccgccccagtttcaggaaggcaaccacgccggcgatcgagatcaggatgatcagaaacagcgtgaccgagcgctcccgcaccgcgagcgccgacaagttgaagccgctcattgcgccgctccttgcgcggagacggatgccgcgatcatcttgtcgttggcgaggcgcacatgctctccgtcgtgcaacaactgggcaccgagcgcgacgacctggtcgccgtcgcgaaggtcgcccgttaccgtcgcactgtcgtcgctcaatgcggtgacacgcaccttgcgccaggtcacgcgcgactgggtccggtcgaccgtccagaccccggtgcccgtgcccggatcgaacacggcgccgaccgggaccaccatgccggcgggtgcgtggccggcatcgtcggcgagatcgagcgtcacggtcgcgccgagcggcgcattcgacagtgcgccctggaggacgtaccgcgcctcgtaggtccgtgtcagccgatcggcggagtcggagagctggcgcaggacggcgggaacaggcttctgggccgcgccgtacagcgtcgcctcggcaatcgagccggatgcgggacgcagcgtctcgggaagctggacgacggcttcgcgggggccggcatgcgcgagccgcacgacgatttgtcccggcgcgacgacctggccgggctccgccagcgtctcgaccactacgccgtcggcgtccgccatgacgacggcgtagccggacgcattgttggcgagcacggcctgcgcctgcgctgcgacgagctgggccttggcggagtccgcggccgccttgagctggtcgtaggtcgatgccgaaaccgcgcctgccgcgacgagatcccgatagcgcgcctcgtcagcggccgtctgcgtcgcgcgcgcctgcgcggcatccacgagcttctgctgtgcacgggcctgcagtcccagatcgatcggatcgatgcgcatcagcggctggccgcgcttgaccgtctggcccgcgtcgaccagccgctcgatgaccttgccctgaacccggaaaccgagatcgctctgaacgcgtgcgcccacgacacccgaaaacgatcggctcgctcccgccgcgccgtgaacggcgctcgtacgcacaagtggcgcctcggtacgcggatcagcggccggatgctcaccgcatgccgcgagcgcaagcgaagccacgcccaatgtgtagacaaaatgatggcgccggaacatgaggtcccctctcgcaaagaacaggagccctcattctgataccggtgaccaattcagtcaacagtcacaaaaagattcatggagcgagacttctgagtaccaggttcgcaagttgggtcgtcgcctcttccgcaccctcgaggttgtactggagcagcagcggattgaaatagggcttcatcaccaggaagatcgcgttcaccgcctcgtcctgcggggtcttgcgttcgaattcgccggtttcgcgcccgagccgcaggacctcggcgacgagttgccggatctggtcctcataaccctggaccgatggccagggtgatgcggccgacacggcggcgatgtcgtaaagcttgcgatcctggaagaaaagctcgcttccggatgaaagcaaggtcttgaacatacggcgaaatttttccgtcgcactgtgtacgccgtcgatgttttccctgacggcggtgatcatcgcggcgaggcgattcgcgcagatgacttgaccgatcgcctgtttggaatcgaagaatttgtagatataggcttttgaaaacccgatttccttcgcgaggtcggaaacggtggtcttttcgtagccgtagcggctgaagtattccgttgcggcgtcgacgatctgggcgcgaacttcgtggtccgaggggccgcgggacggggaggcggagggagtcggtttgttcatgtctcaagcttagcccctcactcgcgagttgacaacgtgtgaccatattgtatattggtcacaacatccgctcaccgttgcgctcccgaaatgatcatgcccctgcaccgttcacttgttctcctgaccagcgtcgccgccctctcggcgtgcgccgtgggtcccgactaccaccgcccggatgcgccgctggcgcagcactacatgacccagccgcccgccggcacggcaaaggctccggttgccgatctgtccgcgtggtgggaaagcttcaacgacccgctgctcacgcgttacgtatcgctggcgctggcgcagaacctggacctggcccaggccgttgcgcaaattactcaggcgcgtgcgcgcctcggcacggccaacgcggcgcttcttccgtcggcctcggtttccgcgtcggccgcacgcgcctatcagtccgtcgacacgccgctgggacaattgctcaatgccacgccgggttactcgcgctggggcaccgagtacgaaaccaacctggaggccggttgggagatcgacatctttggcggtctgcgccgtcagcgtgaagccgcgctcgccgattactcggcgacgcaggcggcggcagtcgccacccgccttgccgtcgcggcccagaccgctgatatctacgtcacgatccggggctccaggcccgtctggacatcgcgacccggcaggtgcagacgcagcaggcgcttctcgcggacgtgaaactcctgtattcgaaaggcgcggcggccgactatcaggttcagcaggcgcagggtgcgctcgaccaggttcaggccggcgtgcccgtcctgctcgcggcgctcgatgcagcgtcgaacgccctcgacgtgatgctcggctcctcccggcacgcaccgcgcggagctgagcccgccgtccctgatccccgttgcgccgtcgctcgcggaaatgggcacgccggccgatctgctgcaaagacgtcccgacctgatcgccgccgaacgtcacctcgctgcggccaatgcgcgcattggcgccgcgatcggcgagtactacccgacggtctcgctgaacgccttcctcggcagcgcgaccgccgctgccaccggcacgttgttctcgggcggcgccaaccaggcggccggcctcgtcgggctgcgctggcgcctgttcgatttcgtgcgcatcggcgccgatgtcgaagcggcgaaaggcgccgacgcgcaagcgctcgcggcctatcggcaggccgtgctccgcgcgtccgaggacgtcgaaaactcgctctcgtcattggtgaaccgacaggcgcaggcggccacgctgtcgcatgccgagtcgtcgttttcccgcgccaaggatgcgtcgatgaccgcgtaccgcagcggtgcggcgagtttcatcgacgtattgcacgccaacgagacgctgctccaggccgccgacgcgcgtgcgcaagcacaaacggaatccgcgcgtgcggcgatctcgacgttcaaggcactcggcggcggctgggatccggcatcgcacgtcgggcagacgtcgctgacttcacgctgacgaagccgcccagcattggcgcgcgcaacgaaacccgcgcactttccgggttcgcgcgagtgcgtaccgcgccattgcagtgcgcgtcgcgcccgcaatcggacagcgtctcgcgcgtcacaacacccatcgcgcggccgtcatcgaattgcgctaaattgggccagatttcgtttgaacacgccgtcgggtaaaggcacaccacgcccgaacgggcgcactccagggcgcgatgaatgaacgacaaggatcctgtcgatttcgggcaacccgttgcagacgacacgctcgccagacggtttctcctgcgagatgcgcccaccgtacgggccggcgttttctcccacgggcaaccgatctcgttcacccggttgatcaacccgcggcctcaaccggggcgctcgctcacgccgcaaccggaggaagcctttgtcttccagatgccgctgatactcggccccgatcccggcctccgttattcaagcggcaacctcgatgcttccgcatcgtgcagtcccggcagctgttatctgctcgacctgcgcgcgagcccgacgcgccgtctcgacatgccgttcgataccatgcggctctatctggcccagggcgcgatcgaggagttcaccgatcaaaagcggcgccggcgcataggaggactcgtgcagccgcatctcggcgccagcgacccggtgctgttcagtctgtcgcatacgctgcagacggtcctgcagcagcccgacctgacgagtgcgttgttcatcgattacctcgcgctggcgttttgcgaacacgtcgtcacacgctatggccgagccgatccggtgctccggccacgccgctccggactcgctccttggcagatgcggcgcatcgaggattatttcgcgtcccacctgcacgacaatccgtcgatcgccgatctcgcacgcgagtgcaatctctccaccagctacttcggcgaagccttcaagcagaccaccggcagcacgccccatcagtggctgctcaagcgccgtatcgagcgcgcgaaatcgctgttgcgggcaaccgatgcgagcctggccagcatcgcgtcggactgcggatttttcgaccagagtcatttttcgcgcgtgttctcgcgtctcgagggatgcgggccgaaagtctgggcgcagcggaaccgatagcaccggacaggtgcaaacgtcacgggcggcgcatgtgtgtcaactcgatccgccgcctcctgatccgaattcagtcactgcccccggtatgcgacggtcgcccgcgaatcgtccaacgaatcgttgttttatacaagatcgcgcggtcaccccgcaggtacgcttctctcacatcgactcgtcgatgcctccgcggctcgtcactcgttgaacgggtggccatcgcggtccggccgtttcatttcggcacacctgccgagatagcacgttgatttgcccgtcaagcctcgcgcggccgccagcccggaacggcatggcgctgcgccggcccgcccaaccctcctggagtcgacgcatgaagaatcgcgatacgtctacgcgtcttgatcacgcaacgggtgcacccgttgccgacaatctgaacatcgaaacggccggcccgcgcggtcccgcgctgctgcaggatatctggctgatcgagaaactcgcgcacttcgaccgcgaggtcattcccgaacgacgcatgcacgccaaaggatcgggcgcgcacggcgtattcacggtgacgcacgacatcacgcgctacaccaaggcgaaactcttttcggaaatcggcaaggcaacgccggtattcatgcgcttttcgaccgtcgccggcgagcgcggcgccgcggatgccgagcgcgacatccgcggcttcgctgtgaagttctatacggaagaagggaactgggacatcgtgggcaacaacacgcccgtgttcttttccgtgacccgctgcgttttcccgatctcaaccacgcgatcaagcgcgacccgcgcacgggactgcgcagcgcaaacagcaactgggacttctggacgctcctgccggaagcgcttcaccaggtcacgatcgtcatgagcgacaggggcataccgcgcagctatcgccacatgcatggattcggcagccatacgttcagcctcgtcgatgccgacaatcggcggacgtgggtgaaattccacttccgtacgcagcaaggcatcgcgaatctgaccgacggcgaagccgaacagctcgtgggcaaggatcgcgaaacgcatggccgcgacctttacgaaagcatcgaacgcggcgactttccgcgctggaccctcttcattcaggtgatgaacgacgacgaggccagggcactaccgttcaacccgttcgacctgaccaaggtctggccgaaaagcgatttcccgttgatcgaggcaggcgtgctcgaattgaaccgcaacccgggcaactacttcgccgaggtcgagcaggcggcgttttcgcccgcgaacgtcgtgcccggcatcggcttttcgccggacaagatgctgcaggcgcggctgttctcttatggtgacacgcaacgttatcggctgggcgtgaacttcaatcacattcccgtcaatgcgccgaagtgccccttccacagctaccaccgcgatggcgccatgcgcaccgacgacaacctcggtggcacaccgtcctactacccgaacagctccggcgagtgggaagtacggcccgaccttcacgagccgccgctgcggatcgaaggcgatgccgcacattgggaccatcgcgtggacgtcgatcacttcgcgcagcccgggaatctgtttcgcctgatgagccaggcgcaacaacacctgctgttcgacaacaccgctcgccagatggcctccgtccacgcgcatatccaggagcgccacatcctcaattgcgcgaaggccgaccccgagtacggcgcgggcgttcgcgaggcgctggcaagaatcggggcaacgactgccacgaagtagccggccaatcgcgtgcggcgtccgccacgacgccagcgtccgctcacatttcgatggagaaccgtcatgtcgcaggtcattcaggatgtcgccgtgcccgacagtcagcttgcgcgggaaattaccgagttcgtgcgcgacacgtccaccccgctgctctttcatcattcgagccgcgtctatttgttcggcgccctggagggcgcgcgccgcggcctgaaattcgatccggaactgttgtacgcgggcgccatgttccatgacatcggcctcaccggcgcgtacagcagcgccaccgagcgcttcgaagtcgacggagccaatgcggcccgcgagtttctctcgggccggggcatcaccgcggccgacatcgatctcgtctggacggccattgcgctgcataccacgcccggcattccgcgccatatgcacccggttgtcgcactggtgaccgccggggtcgagatggatgtgctcggactttcgtaccacgcgttctcgcacgaggaacgcgaagccgtcacgcatgcgcatccgcgcccgccgcacttcaaggaagagatcattcaggcgttctacaacggcatcaagcacaaaccggagaccacgttcggcaacgtgaaagccgacgtgatcgccgacaaggagcctcatttccatcggggcaacttctgttccgtcatccgcaattcggcatggccgggttgacgatgccgtgtcccgcgcatcgatgcccggccagtcgtgccgcgccaaccgatcgcgaccgcatgcaggtccgcataggcagaaaacactggcgatcgcatcgtgcgagacggcaggccagtgtccatcaacggaatcattcacactgaggtgaacatcatgggcaagcttgcagggaaagtggccgttgtaaccggtgcgtcgaagggtatcggcgccgccatcgccaaggcgctcgcggcagagggcgcgtcggtcgtcgtgaactacgcaagcagcaaggccggcgcggacgacgtcgtgtccgccgtcaccacggccggtgggaaagccgttgccgtgggcggcgacgtgtcgaaggcggccgacgcgaaaggcatcgtcgatgcggcgatcgaaacgtacggccgcctcgacatcctcgtcaacaactcgggcgtctacgagttcgcgccgatcgaagcgttcacggaagcgcaataccgcaggcagttcgacatcaacgtgctcggggtcctgctcacgacacaggccgccgtccagcacctcggcgaaggcgccagcatcatcaatgtcagctcggtcgtctcgacgctcacaccggcgacgaccgccgtctacagcggcacgaaaggcgcggtggattccatcactggcgcgctcgcgcgtgaactcgggccacgaggaattcgcgtgaacacgatcaatccgggcgtgatcgtgaccgaaggcgcgcaaagcgccggggtgatcggatcggagttcgagcattcggcggtcagccagactccgctcgggcgcgtgggcagaccggacgacgtcgcatcgattgcggttttcctcgcttccgacgacgcaaagtggctgacgggcgagcacatcgtcgccagtggcggcatgcgctgacgcaggttcgcgaaaccgcgggcgtaccgtcggcctcgacatcgacaaacagaaaggtgacggtcgttccggatcgcccgcggttcagtgggttgccgcgtgagtctgccaacgatacggtttggtaaccggcacactttccggccaaccccggccgcccctacaccctccccgccaaatgaaaccgcgacgccggatgccacaaccgcaccgacgtcgcgacctgttcaccgacccaggtccgccgccggagcaacaagcacggctcgccgatttccatcaccagatgccggcgcacctgcgcatcgggcttctgcgcatagatccggaactccgcacgctggatcggcgcgagccgcaccatatagtgattcggcgtctcgaccgtgaagtcctgttccagatacgcgggaaacagcgccgggttcacatagcgatcctcgaactggatcggctcgtcgtcctcgtaatgcacgatacgcgaatggaacaccggccccgagcgcagcccgagcgcttcgatcgcctccgtatcgtcgctgctttcgagcagcagcacgcgcccgctgtgccgatggccgcgctccgcgatctcgtccgcgatgttgcggatttccagcaccgtcgattcgtaatgccgccgttcgacgaacgtgcccgcgccctggatgcgggtcagcacgcgctcggcggtcagctcgcgcagcgcacgcgacaccgtcatccgcgcgacgccgaactccttgaccagttcggcttcggtcggaatcgccccgccgggtttccagtcgcctttcgcgatccgctcgacgacgtagcgcttgatctgctggtaggccggcagcgcgcgcgccggcacgtcgtcgcccgacgcgaccgccagcccggcggaaaggtgtcgttccgtatggttcatgcgccctcgcccgaatgattattagatgtccagataacccgccaccgccaccgcccccgtcacccgacgtcacagcaccggcggcggcatccctgcgacgatgccggtcgcgatcgcgatgtcgtccgcgagcggccggtcgtcctggtacgcaggcacgcgttcgcgcacgtgccgccacaacgtatcggtgggcgcggcccgcgccgcgccgttcgcctgcagatcgtacgcctgcgcggccgccagcatctcgatcgcgagcacgcgcgtcgtgttctcgatgatgtcgagcgccttcagcgctgccggcgttgcatggcacaggtgatcttcctgcagccccgacgtgatgccgccgtcgaggctcgcgggcgccgcgagccgctggttctgcgcgacgagggcaactgccgtgtactgcgcgatcatgaagccggagcatgtgccgcccggcgtcgcgagaaacgccggcagcccgctgacgagcggattgacgagacggtcgagacgccgttcggcgattgccgcgacctgggccatcgcggccgcgaggctgtccatcgcgagcgcaatgccggcgccgaccgcatgcgcctgcgaatagacggccggttcgtcgcgcgtgccggcgacgatcgggttgtcggtgacggacgccagttcgcgatcgaccacttccgccgtcacggcgaatacgtcgcgtgccgcgccgtgcacatgcggaatcgtgcgcaggctgagcggatcctgcgtatgccggccgctcgccgcgccgagcatcccgctgtcggcgagcagcgcgcgcagccgtgcgccgacctgcccgatgccgggcgaaacgcgtagcgcgagcgatgccggatcgaaggaggccagctgtccgccgaggttctcgaagctcatcgccgcgacccagtcggcccagtcgagcagccgctccgcgcgggcgagtgcgagcgcggccagccccgtcacgcacggcgtgccgttgacgaggctcagcccctccttcgcaccgagcaccagcggctcgcggccgatgcggcgcaacgcttcgtcgccgcgcatccgctcgccgcgatggcgcgcatggccgtgaccgatgcagacgagcgcgacgtgcgccatatgcgtcagatacccgaccgacccgtgcgccggcacctccggcaggcaatcgtgttcgagcagcgcgacgagctggtcgacgacatcggcgcgcacgccggaatgcccgtgcgcgtaattgttgatcgccgccgcgatgatcgcgcgcgtttccgccgcgccgagcggcgcgccgacgccgaccgcgtggctcatcaggatgttgcgcgacagcgtgctctgctgcgccggcgacacgatcacgttgcacagcgcgccgacgccggtgttgacgccgtacgcgcggatgccgcgcgcgacgatttcatcgacgagctcgcgtgccgcggcgatgcgcacgcgcgcttcgtccgtgagcgccagcggttcgccggcggccacctccgcgatctgccgccagtcgagcggccttgccgaacggaatacggtcatgatggcctcagttcgcggcgcggtcgtgatggctcgacacgaactgccggaagcgctccgagcactggccgccgaacaggtcgccgggcgtgccgtcggagtcgacctcgccctgatgcaggaacatcacgcgattcgacacgtgccgtgcgaaacccatttcatgcgtgacgaccagcatcgtgcgcccttcctcggcgagcgaacgcatcacgcgcagcacctcgccgaccagttccggatcgagcgccgacgtcggttcgtcgaacagcatcaccttcggatgcatcgcgagcgcacgggcgatcgcgacgcgctgctgctggccgcccgacaggtgcgccggatagtagccgcgcttgtccgcgaggccgacgcgcgcgaggagcgcctccgcttcctcgaccgcttcggcgcgactgcgcttctgcacgcgcagcgggccttcgacgaggttgtcgagcaccgtcatgtgcgaccacaggttgaagttctggaacaccatcccgagctgcgagcggatccggtcgacctggcgccggtcgcccggctgcaacttgccgtcgcgcgcgcgcttcatcttcagttcctcgccggcgagcgcgacagtgccgtcgtcgggcgtttcgagcaggttcaggcagcgcaggaacgtgctcttgcccgagccgctcgcgccgaggatcgagatcacgtcgccttcgtgcgcgtcgagcgaaatgcccttcagcacgtggtgatcgccgaacgacttgtggatgttcctgaccgacagggcaacgggagcagcggtgttcatcggattctcctggagggatggatgcgctcaggacgcgacgcgccgggcgtcgcgcgcggccgcggccggcgcgccggtctgctttggcgcgcgcaggtggcccgacagccgccattcgagcgcgccgagcacgcgcacgacaatgaagttcaggcccaggtagatgagggccgcgcacacgaacacctcggtcgtccggtaggtctgttgaatgatctgctgcgcgacgcccgtcacttcccacacggtgacgaggctcgccagcgcggttgacttgacgagcagcacggcttcggtcgaatacgcgggcaggcactggcgcagcgcgatcgggccgatcacgcgacgcagcagcgcgaagcccgacaggccgatcgaataaccggcctcgatctgcccgaccggcacggccatcaagccgccgcgcaggatttcggccgtatagccggccgtgcacagcgcgagggacagcaccgcgcacacatacggttcgcgcagcagcggccacatgaagctctcgcggatcacgccgaactggccgagcccgtagtacacgaggaacatctggatcagcagcggcgagccgcgaaacacgaggatgtacgcacgcgcgaagcggttcggcagccagtgcggcgacacgcgcatcgtgacgatgacgagcgacagcaggccgccgagcacgagcgatgcgaagaacaggccgagcgtggtcggcacggccgcgagcagctggcgcagcgtgtcgaggagaaagtcgaaatcgatggacatgcgatcgctccgtcagttgcgtgcgaaattgcggcggaacgagcggccgacaatcgcttccgcccggttgaacacgcggttcgacaggcccgtcatcacgagatagagcgccccgcccgcgacgaagaacacgaaatactggtgcgtcgagttcgcggcgatctggctggtgcgcagcagctcggcgagcccggtgaccgagatcagcgcggaatccttgaggctcagttgccacacgttgccgatgccgggcagcgcgaaacgcagcacctgcggaatcaggatgcggcgcagcaccatgcttcgcggcatgccgatcgagcgcgccgcttcgagctcgcccttcgacacggccagcacggccgcgcgatacacctcggcctggtacgcgcccgagatcatcccgaccgccagcgcgccgatcacgaacggcggcacgccgatgaagccttccgcgccgaaccactggccgacggtcgtgacgagcgtcgagccgccgaaatagaacaggtagatcacgagcagttcgggcacgccgcgaaacacggtcgtgtagaggtcgccgagcacgcgcgcgctgcggtggcgtgacagtttcgcggctgcgatgccggcgccgatcacggcaccgaccgcgagcgcggcgatcgtcagcgcgatcgtcatcagcgccgcgagcagcaggacgccgccccagccttcggttccgaagcccagcatttcaaggatggccatgcgtgcctcccggcaagcgttgagtggatcggcaggatgcgggccgctgcgcgaccgtcgggtcgctcatgcagcggcggccgcgcatgtgcttacggcgtgacgtcggtcttgaaccacttgtcggcgagtttcttcacggtgccgtccgcgagtgccgcgccgatcgccgcgtcgaacttcgtcttcaggtcggcatcctgcttgcggaacgcgaggccctcgcccggccccagatcgggccgccgagcttcgggcccgcgagcacgatcgacgcgttctccttcttcccggtattcgccgcgtagtacgtgacgtcgtcgaacgatgcgtcgatgcgaccggcgacgaggtcgagatcgcgctcgggcgacgtcttgtatacgcggatcgacgcgatgtccttgaagccgtcgttgatgaacttcgtatagacggtgcccgactggatgccgatcgtcttgcccttcaactgcttgcgcagcgcatcgacggttgccttgtccgcattcgcgtcgccggtcagcttgacgatcggcgcgccgggcgcggccttcggcaggatcttcgtatcggtgacggcgaacgtcgcgggcgtggccgcatacggacgcgagaacagcaggatcttctcgcgctccggcgtgatcgagatcgcatccatcaggatgtcgaacttgccggcctgcaggcccggaatcatcccgtcccagtcctgcgcgaccatgttgcactggaccttgatccgctcgcacacgttggcgagcagctccggttcgaagccgccgagcttgccgcccggcagcgtgaggttccacggcgcgtagccgccttcgagcgccaccgtcaccgtcttccattcctttgcctgcaccggcgcggcgagggttgccgcagccgccgcgatcgcgccgatcgtcctgattgcccaattgatgcgcttgccgttcacgagatttctccttgcgttgaagttcgtcatcccttcggtctgcaagacgcctcaggaatttgtctatacaagcatgcaagaagaaaaacggccggacaagcgttgatcaaaaaaaccgcgtaaacgcggaaatccctaaatacggggctctgacgcgcctcttcgcggggaattcgggcacacgtttggtgcaagatgaatggacaaatcgccaggatgactagacaaattttgaattcgatcactcgacgcttgccgcgcgacatgcggcggcgggcaactcgacctcgcgcaaatcggggcgctgaccggaacgccggttcatgctcgatcgattgtttcgggcgcgggtttggccgggatcgatgaaccgtggcgccgcttgcgctgtcggtcatcaggaaggcaggcctggatcgtggccgcttgcgcagcctgcaatgggatcagtgcggccgatgggccggtgttcgggtgggggcgtgccccgttgctgacgtcagtgccggatgcacgacgtttcccgcatattggcaagtaccgaaatcgcgcggcacggcgtgaagacgagccgggaaatggtctgaccatacgtcggcgtcacctggaacacgcccctgcttcgacttgctgccgccgtacgtggcgacgaagctgtcggtgaaacggtcgaattcctcgggcgggcgccgcgtacacgtgcgccgtgtcgtcatgcggcccgaccgcgagcggcggcgccggtatggcgacggatttcggccacgccgcgaacgccgtgcgtgcggcgcggaaaccgcccgccaccatcggcgccgggcatgtcgagcgaacgtgcttcgtgatcgccgctccttcctgttgcaatcgtctggagaacagacgatcagcttcgaccgtccccttccccgcttcgcacatcgccgagcatcgtgacgagcacgagcgccgcgatcagcccgagatgctcgaaaaagctgttgagcgccatgaaacgcgcggcgcccgtctggttccagaagtcgttcgccaccgccatcgcgacgagcgtcagcatgccgaggccgccggcgccgagccacgtgaagcggcgaaacacaatgcacagcgaaccgccgatctcgacgacgaccgccagtgcagcccacaacgcgggcgggtgcaaaccgaaatgcgcctgctccgcgattgctgcgtcgaagtgcatcgccttgttgatcccgccgatcagaaaggcggacacgagtgcaagtcgaaccagcgcgccgatccacggctgcgcgagcagcgcacggatccacgcggggctgtaccggccggttgtcgtcgccatgtcagaccgcccagcaggaacagccgaacgcgccccagaagcccttcgtgtccgacgtcggcaatgcgctgccccacgcgctcgcgtgcgcatgctggtgcacgttgcacgcattcgcgcagccgcacatcgcggccgccgccgccgcgcgttgcagcggtgcgccgctgcgctgcgtcgcgccccagccgccgtagccgccgtactcgcgcaccggcgaccagtccggcatcgcgggcggaatcggtgcgtcatgcgacgcgaacgggcccgcgccccacacgatccggccgccgaccaccgtcagcaacgcggtcgtgcccgcgatgtcgtcctccgcgcacgcgaagaagtcgcgatccggcacgaccacgtccgccagctgcccgaccgcgatccgccctttcttgccgacctcgttcgagaaccacgtcacgtattcggtccacatgcgcagcgcggtctcgcgatcgagcaggttgcgctgcggatacatgcgcagcccgccgatcgtcttgcccgtcacgagccaggacagcgacacccacgggttgtacgacgccacgcgcgtcgcgtcggtgccggccgacaccttgagacccttggacagcatcttcgcgaccggcggcgtcgcttcggccgcctgcgcgccgtaacgctcgacgaagtattcgccctggtacgccatccggtgctgcaccgcgatgccgccgcccagcgccgcgatacgatccatcgacttttcggtgatggtttccgcgtgatcgaagaaccagttcagcccttcgagcgggatgtccttgttcaccttctcgaacacgtcgagcgcgcggctgatcgtttcgtcgtacgtcgcatgcatgcgccacggccagcggttctgcgcgagcacgcgcacgacgccctcgagatcgtcttccatctgcgccggcaggtccggacgcgcgacgcggaagtcctcgaagtcggccgccgagaacaccagcatttcacccgcgccgttgttgcggaagtagtcggtgccgtcgtgatacttcgtgctcttcgtccagttcacgaagtcttccttctcggcgttcggcttctgcgtgaacaggttgtacgcgatccggatcgtcatctcgcccgcgtcgtgcagcttgcggatcacctcgtagtcgtccggatagttctgcgaaccgccgcccgcgtcgatcacgccggtcacgccgagacggttcagttcgcgcatgaagtggcgcgtcgagttgtactggtattcgaacggcagcttgggccccttcgcgagcgtcgcgtacaggatcgtcgcgttcgggttcgcgagcagcagcccggtcgggttgcccgcggcatcgcgcaggatcgtgccgcccggcggctccggcgtgtccttcgtgtagccgaccacgcgcagcgcggccgcgttcagcagcgcgcgatcgtacaggtgcaggatgaacaccggcgtatcgggcgcggccgcgttgagttcgtcgatcgtcggcaggcgcttctcggcgaactggtgctcggtgaagccgccgaccacgcgcacccattgcggcgcgggcgtgatcgccacctgccgcttgagcatgtccattgcaagcgcgagcgacggcacgccgtcccaacgcagttccatgttgtagttcaggccgccgcgaatcacgtggcagtggttgtcgatcaggcccggcagcgcgccgcggccctcgagatcgacgaccttcgtcgcgcggcccgcgagcggcatcacgtccgcgtcgtggccgaccgcgacgaagcggccgtccttgattgcgacggcgctcgcgccggggttcgcgcggtcgagggtcgtgaaccttccgttgtgaaggatcagatccggttgggactcggttgcggtcatgtgcgtcacctcgtatcgatcagaagccaaaaagctgtttgacggcgggaatggcctgcacgccgatcaccatgccgagcaacccgacaagggcaatcagcggcggtgccggagaacggaccttgatcgcgctgtagatcacgccgatcagcaaacccgcgccaagggaaaccagataaggttccatacgatcaatgtcccggtcaggttgaaatgcaggctttacgtcctggaaaacaggcgcgggcgacatccgtgaggcagtcacggcagccgcccgcgattttcatggagccgatggcgcgtattcgtgcagaacacgcggcatcggcacgggcagtcgcaactgcccgcgattacttcgccggaaccggcggaatcgactcgtgcggcgtcgccgtgcgcggtgcagccttgtggaccatcgtgtacgcgtagtcgacacccatcccgtacgcgcccgagtgttccttcgcgatcgccatcacagcgtcataggtctcgcggtgcgcccagtcgcgctgccattcgagcagcacctgctgccaggtcaccggcacgacgccggcctgcaccatccgctgcatcgcgaagtcgtgcgcgtccttcgacgtgccgcccgacgcatcggcgaccatgtagatctcgtagtcgccttcgagcatcgcgcagagcgcgaacgtcgtgttgcagacttccgtccacaggcccgacacgaccaccttcttgcggccgttcgcggccagcgcgtcgcgcaccttctggtcgtcccacgagttcatcgacgtacgttcgagcgtcttctggttcgggaacacgtcgagcagttcggggtaggtgtaacccgagaagctgtcgctctcgaccgtcgtgatcgtggtcgggatgttgaacacctttgcggccttcgcgagcccgacgacgttgttcttcagtacctggcggtcgatcgactgcacgccgaacgccatctgcggctgctgatcgatgaagatgatctggctgttgtggggagtgagtacttcaagtttcggattgctcatggcggtcatatcctttgacgcgggaaaagagagagccagcctcaccggccaaccgggaggcgcccactgcgctgtgacgggaggttcgcctaccagccggtgtcattcaacacgcgaattcatcgtagcgccaattaatcgatttgattaataaaaacctaaattcaggccttaaaagatcttaaaaccgccgaattaaatacgcgcctccggagcagacctgctacgctccaaattgattttccgatcatcgaccgatcggtatttatccgtatttttcacacggttgtcatttcccttattcgaatcatgacgtcctatattgcatcgttattggccggcatcctcgcgggcgtcgtctacgcgctgatcggggttgcatcgccagcgccgcccaccgtcgcattggccggcctgctgggcatcctcgccggcgaacagatcctgccggtcgcacgccgcgtgctgtccgggatccagctgaaaaccgcgtggagcgacgcgaagtgcggccagcacatgttcggcacgctgcccggtgcgcaggtcacccggggcgccgcgaagaaagggccgtcgacgccggcctgatgcgcgccgatcgagggcgctccgatcgcgtacgcggctgaattgtcgtgaatcgtgttggagccgggcgtgcttggcgataacatgacagcccgatgcccccgtggaattcatcatgaagctgtcattcgaagcgctcgaggcactggacgcgatcgaccgcaccggcacgttcgccgaggccgccgagttgctgcaccgcgtaccgtccgcgctgacctatctcgtgcaaaagctcgaaagcgatctcggcgtcgcgctgttcgaccgcagcggacgccgcgcgaagctcacgcacgcggggcgcgtggtcgtcgaggaaggccgccggctcctgcatgcggccgagcagctcgaactgaaagcgcagcgcgcgcagcaaggctgggaaaccgaggtgcgcatctgcatcgacgagatcctgcccttcgaggcattgtggccatacgtgcatgcgttctacgggctcgagatggacacgcggctgcgcctgtccaccgaagtcctcggcggcacctgggatgcgctgatttcgcgtcgcgcggatctcgtcgtcggcgcggcgggcgagccgcctgaactgccggacatcgtcgcgcggccgatcggctcgctccggcacgtgttcgtcgtcgcccccacccatccgctcgcggcattgcccgaaccgctgtcgatggcgtccgtcgtcgagtatcgcggcgccgtgatcagcgatacgtcgcgcgagctgcagccgcgctcggtcgcgatcgatgccgggcagccgtatctcgcggtccccactctcgccgcgaaactggccgcgcagtgcgaagggctcgcggtgggcacgctcccggattgcatcgcggcacgcgcgatcgcgcagggcaagctcgtcgcacgcgaggtgaccggcatgcgcgacacgacgcagtgctatctcgcgtggcgcggcgacgaagccggacgcgcgctgcactggtgggtcgaccagctcgatcaacccgatctcgtcgaccggtttaccgcgctcgtctgattccgccgcccgcggcccgcgttcgcccccggccgcaggcaaccgccccgcatcagccgaacgaatcgtgcaggcgcttcatctccttctcgagccactcgatcagtttgaacgacgcatgcgcactcgcggccggcgggatcatcatcttctcctcggtcgcgatgtgttcggacagcgattcgcacatcagccgcccgagctcgggcttgcgcgcgatcagcggcgacaggtcgccgctgctcagctgaaacgccgttaccgtcgttaccgcatggacgctcgcgtgcagttgcgtgccggccagcacgacggactggccgatcgcgtcgcccggcgccatccgcctgacctcgatgtccccgccgcgcccggcacgaacaccgatgcgacgccggcgccgacgatggtcagcaggcgcgtatcggcattcgacgcatagatcacgtcccctttgtgaaacacgcgtgacgcgagcgcatcggcgagcaccgccagatcgtcgtcgccgagctgccggaagagttcgaccgcgcgcagcagccgttgcccgcgcgataccggccggtgcgtcgcggccgtcccgcccagcgggcgcaacgcgatgtccgcggcggccagatgccggtgggccaggtcgtagagttggttgcgcacggcgatcttcttctgcagcgcatcgacgtagcagacgagctcgtattcgacggaattggtacggaacgccttgacgaccgaaaccggtgcgggacgggtcagcacgtccagcgagctggcggcggcgcggtcgagcgcatcgatgacgatggccggccgcacttccggatcgatctcgatcgtcaacgtcacgccgtgcacgttctcgggttcgctcaggttgacgatcgtcgtcttcgccgccgtgctgttcggcacgacgaccaggttgccgaggccgtcgatcagcttggtcgcgcgccagttgctttcgacgatgcgcccttccagctcgccgatggccaccgtgtcgccgagccggaacggctgggtggtattcagcacgaggccggagaacacgtcgttcagcgtgttctggacggccagcccgaggatcacggccaccgcgcccgacgtcgcgaccagcccgctcagcggcaggcccagcacgtagccgagcgcggccaccgcggccgcgccgaacacggcgccggcggcgatgtcgtgaaacagccgctgggtgcgccacgcgcgcggcagcagcagatggtcaagcatcaggctgaacacgagcgcgcactgcagccaccacgcgaccccgatcacctggatcgccagccggtcgagccggtcgggcgacggcggcaccgcgagcgggctcacgccggtcgcgaacagcacataggtcagcgcggcgaacgacgcgcagcgccctatcgctttcgccgtcgaacggccgggcccgagcaaccgccatgcgacgagatcggcaatgacgatcggtgcgccgtaagcgaccgtggcggaaaggttcagcatgatggagcggacggcaagcgtgacacacgtcgcgagcggaacccgcgcgcgcacatcgcccacggcccgatccggcgtgtggccgcgggcggcgaatcgtggcgcgaaaggtcggactggacaggtttcatgcggtagtcgttcgatgacgcgcgaagccgccgcggccgcacgtgtggcgaccgccgccccgcgccggcattcagcggcgtcgcgaccgcgcgacgccgcagcgcgagccggtggcgtgccggcctgcccgcgtatcgccgacggtccgtgcgtccggtcaatgtagacgcaccggccggcccggtcatgtgttcagcctgaaacgttctgaagccgcgacggccgcgcgccgctacgattcgcgcggcggcagctcgctctcgcccgtgtcgaacccgagcgcgtgcacttccgaccacgcgtcgtgcgcgacctgcgtcgacccggcggtatgggcgagcgcggccgcatacgcggccagcagacgcacgcgcgcgtcgtcgcgcgtgcgcgtctcgtccatgtcgcgcatcgaatcgagcgccgcgcgcgcgttcgcgacattcgtcgaccagcgacaggtcgaacaggcatggcaccgccacggccgccagcgcgatgccgatctccgcatcgccgttcggcgaaaacgcccagtcgagcgccgcgcgcaggttgccgagctcgcgccggatcacgtcgagccgcgattcggcgagcggcccgccgtcgtctaccggcacgagccggaacagcgtgtggaagtagttcgcgtgagcgcgggcggcggccgcgcattcgccgttgttctcgagttgctgcaacgcgtatgcacgcgtcgtcgtcagcagacggtaacgcggtgcgccgtgcgcgctttcgagactcagcagcgacttcgacacgaggccggcgatcgtgtcgagcaggtccgcatcggccagccgcgtggcgccgacgatctcccgcaccgcgtcgatcgagaaggtgtcgcggaatacgccgagccatcgcaacagcaagcgctccgcatcgccgagcaggcggtagctccagtcgtacatcgcctgcagcgtctgatgacgcggcagcgccgtgcgaaacccgccggtcagcaaccggaaatgatcgtcgagatgcgcggccagcacgtcgatgccgagcacggccgcgcgggccgcggccagttcgatcgcgagcggcaggccgtcgaggcgccggcacaccgacgccatcagcgacacgctgcgttcgtcgagcgggaaacgcggatcggcggcctgcacacgcgccgagaacagctgcaccgcgctcgcgcccagcgtttccgcatcgtcggcaccttcgcgcggcacctcgagcggcgggatcggacacagccgctcgccctggatacgcagcgcctcgcggctggtcgcgaggacgcgcaagccggcgtcggattcggtcagcgcgctcgcgatccgcgcggccgcgtcgagcagatgctcgcaattgtccagcaccagcaacatccggcggttcgcgacgctggccagcaccgcctcgagcgtcagcgatccggcggactgtgcgatgccgaacgccgccgccagtgcgtcgggcacgaattgcggacaggcgaccgtggccagcgacacgaacgcggcgccgtccggaaaactggcttcggcgcgcatggccgcttcgagcgcaacccgcgtcttgccgatgccgcccgccccgaccagcgtcacgacgcgcgcggtgtcgagcgccgccagcacctcggcgacggtctgctcgcggccgacgagcgcggtcggcgcggccgtcagccgcgatgtcacagcgcgcacggggccgcgacctcggcccggccgccgaccagccgatagccgcgccccggcaccgtcacgatcaggttgcgatcgtcggcgagcgccttgcgcaacgcggcgacgtgcacctgcaggttgttttcctccacgaccgtgtgcggccacacgcgctgcatgatctcgtctttcgagaccagggcgccgtttgcccgaatcaggagttcgagaatttcgaatgcgcgactgccgatacgcagcagtttgccgttcgagcgaatttcacgcctgtcaagaaatacgtgtagcgttccaattcggatcatgagaattttcaatcgatagcgtgcatcgatgccctgtcaaaaatgacatcgattggacgctcatgctacggcatttgcctcttgagatgattcaaattatcagaagctattgagcaaatttttgaatcgatgaaaaccacgatttcccggcgtctccgcgtacgggcgccactgccccagtgcggtgcggcatcccgcgctcactgcacgcgaaacagtgattcatccatgaatctgtttcgtaggataaaacctgcgatttgccggaattaacttcttcgactcatcaattaaatataaccgcacgccggatttgcggataagaccgggtaaaaagacatgccggacatggtgtaaccgatttcgcgggcggcggtcggtcggattttccgttcataacgattcaggcgccgctcaggacattcagcggcgcggcgcgcaacgatgggtcgatggcgccagcgtcgagcgactttcaccacgccgtgaggaacacgaccatgggcaaccgtatcgccggcatcaggattcccgacgccccgctcgcacgggacgccgccgacaccgtacgcgcgtgcgaaccggaactgctgttccggcacgcgatgcgcgtgttcgcgtttgcatcgatcatcgggctgcgtcgcggcatcgcgttcaacgccgagctgctgtacgtcgccgcgctgttccatcacttcggcttgacggagcgctaccggcattcgcgccggcgcttcgaggtcgacggcgcgaatgcggcgcacgcattcctccgaggatatggcgtcgccgccgacgacgcggcggaggtctggcgcgcgatcgcgctgcatgcgacgttcgggatccacccatacatgacgccgttgacggcgttgctcggcgccggcgtcgagaccgacctcttcgcgcatcacttcgacgaggtgagcctgcccgaacgcgatgcgatcgtgcgcgcatggccgcgcggcccttgcttcaaggacctgtttctcgaagcgctcgccgcgggcaccgcgcatcgccccgctgccgcgttcggcaacgtgtccgccgacgtgctcgagcgttgcgacccggactatcgtcggacgaatttctgcgggatggtgctcgggtcgaaatgggcggagtgagccggccgtccggccgggcccgtgcggccgcgtcaccgccgccactgccggatcatgcgcgcgcgaacgccagcagttcgtcgttcaggcgttgcgcatgcgtcaggtacaacgcgtgcgggccgccctcgtagatgctcagcgtcgcgtgcggcacgcgccgcgccgtgacggcgcccgtgagcgcgagcggtgccgtctggtcgtcgtcgccgtgaatcacgagcgtcggcacgtcgaacttgtcgagatccgcacggaaatcggtttcggaaaacgcgccgacgcagtcgagcgttcccttcaacccggcctgcagcgccatgaacgacgtccagtcgagcgcggcgcgcgagattgtcgaagcggcccggttcgacccggtgaacagcggccagaattgctcgtagaacgccgcgcgatcggccacgatgcccgcgcgaatcccgtcgaacacggcgacgtcgacaccgtccggatgatcgtcgcgccgcgcgaccagcggcgtcaccgagccgatcagcacggctttcgcgatgtgccgcgtgccgtgccggccgatgtagcgggccacctcgccgccgcccatcgagaagccgacgagcgtcacgtcgtgcagcccgagcgtgtcgatcagcgtcgcgagatcgtccgccagcgtgtcgtagtcgtatcccgtccacggctggccggagcggccgaacccgcgccggtcgtaggcgatgccgcgcaggccgttcgacgcgaggtgatgcatctggacgtcccacatgtccgcgttcagcggccagccgtgaatgaacacgaccgggcgcccggcgccccagtccttgtagtgaatcgacacgccgtcgcgggtcgtgaacgtgctcatacggattcctcagtggtgaaaaagcggtgcgcgccggcgtcggccggcggacggggtaccgcgtccgccgtcacgaccgggatagccggccgatgaaccggtccatctcggacgcgaggatcacttcccggtagttcgcgggacgcttggccccgcgccattgcggcttgtagatcgcgtcgccgggacgaatcgtcgtgccggtcagcgcgcagcgcgcgagtgcgcgcgacttcgcgctgatccagcgctgctcgtcgtagcggcagcgcgtcgggtcgctccacgacaccaggaccgacgaatcggtctgccgctcggcggcgatgatcgcgcaacgacggcgcacgccgccgctcgacgcggccgatgcatcgttgcaatggcggcggcgcgcggtgtccgggtcgcgcacaagcgacggcgcgcaatggcgtgcggccggcgacgggtcgagcagcgtcatcacgtgctcccagcgatcgaatgcgtccatggcagatccaggcaggtgaggcgggccggatgccttgcacccgcccgctacgcgatcgtcatccgccgcgcgagccggcaccggcccgcgacgggatgacctgacactgacgatagcgggccgccgctgaagagtcttgatgcgagacttaatttttctggccggtgcgcacatgcgtcgcgctgcgtgcaccacatacggcttcacgaaaattcagcgcgatttcagtacagcccgcatggccgcgggataggctcctgtcggctttcgttcacgacgttcgcgcgccggcctgcgcgcggcctctcgaacgcacgccggctgcccgcgggattgccgcctgcgggcagacccgaacccaccatccaacgcggcatcgttgtaccgcacgttcaaggagacttcatgcgtcccgcagataccgacgccgttcctcggcacgccgccgagacatgctgctcgccggcgcgaccgccgttgcagccgccgcgctgccggcagccgccgcggctgcccccaagcatgccgcttccacccatccaggagcccatacgatgaatacgatcaccacgaaagacggtacccagatttactacaaggactggggcagcggccgtccggtcgtgttctcgcacggctggccgctgtgcgccgacgcatgggattcgcagatgctgttcctcgtgcagcacggcttccgtgtgatcgcgcacgaccgccgcggtcacggccgctcgagccagccgtcgcagggcaacgacatggacacgtatgccgacgatctcgccgcgctgatgaacgcgctcgacctgcacgaagccacgctcgtcggccactccaccggcggcggtgaagtcgcgcactacatcggccggcacggcacgaagcgcgtcgcgaaggccgtgctgatcggcgccgtaccgccgcagatggtgaagtcggcgaccaatcccggcggcctgccgatggacgtgttcgacgggatccgcaagaacgtcgcggaaaaccgctcgcagttctacaaggatctcgcggtgccgttcttcggcttcaaccggccgcaggcaaaggtgtcgcaaggcacgatcgatgcgttctgggcgcagggcatgatgggtggcgtgcacggccagtacctgtgcgtgaaggaattctccgaggtcgactacacggaagacctgaagaagatcgacgtgccgacgctgatcctgcacggcgacgacgaccagatcgtgccgatcgacgattcggcccggctgtccgcgaagatcgtgaagcacgcggaactcaaggtgatcccgggcggctcgcacggcatgtgcgtcgtcgatgccgcacggatcaacgctgaactgctcgcgttcctgaaggcgtaagccgcgcgacacggcgcgcccggccgtcacaccgtcacgccggcgcgcccttcagcatttttcaggaattttcaggccgacgcgattccgcatgccgcatgcgccgtcgccaggatcgccgccgcggcggcgggcgctcacggcgtgcgcgccggcctgagcagcaaaccgatcaacgcacccgcgatcgcgaacgccatcgccacccggaagttgtcggccagcgcgagcgtggtcgcctggacgcgaaccgcccggtcgagcagcgcgtaagtcgcctggtcgccggccgcgaaggtcgcaccgtgcgcgaccagcgacgccgcgccggcccgcagccgctccagcgtttgcggatccgacagcgtgacatgcagaccgacgagattcgaatgggtagcctccatgatgcgctggatcaccgcgatcgacgtcgtgccgagctgcccgctcagcaggcgcgtcgtctgcacgaccgcgccgaacgtcagcgcgtgctcggccgtcacgtgcttgccgaaaagaagatcaccgacgtgagcgccatcgtctggcccaatgcctgcagcagctgcgacgggatgaaatcgggttcggcccacacgggcgtgaggcgcgcgccgagtgcgaacgcgaacgccaccatcacgaagccggtgacgatcagccggcgcggatcgacgcgttgcagcagccatgcgacgcatggcgcgaacagcagcgggatcgcgatccagcgcagcgtgtcgccgatctgcagcgggcgcagcccgtaggtgctcgcgagaaacgccgacggaatgaagctcgtattgagcacagtgaagcgcacgaggccgaccagcacgatcagccacgcgatgttgggccgcgcgaggtaaccgagatcgagcccggcgctgcgcgacgccagctcgtggatcaggaacgcggccaccatcacgatgccgacacacagcaacgtgacgatcagcggcgactggaaccagaacagccgttcgccctgatcgagcgcgacgcacaggcacgcgaacccgccggcgccgagcaccatgccgcgcgtgtcgataccggacgcgaagcgcttgaccggttcgttggacagcgacagcatcaggcacacgatgaacggcacggtcagcagcgcgttctgccagaacagccagcgccagctcaggtgttcgctgtaccacccttcgagcgtcgccgacaggttcagcgacatctcgaggttcatcgcatacgcggcgatgccgaacggaatgagccgcggcggcagcgtgcggacgacgaacccgacggtcaacggcacgaacacgccggacgcgaaaccggctacgctctgcagtgcgatgaacgtgccgaagtcggtgcacagcggcagcatgctttcgacgaccaggaataccgcagcgcccgccagcagcacgcggcgcgtgccgaacacgaaggccgccgcgatcgcgagcggcccgacgaacatctgcgacgcggtgaacgcggtgttgatccacgcaccctcgtcgaagccgacgccgagcgcgccgcgtacgtcggcgagcccgagcgacgtgatgcgcgaggtcagcgtcgagatgatcgcgccgagcagcacggccgcgattgcggcgatggaacgaaacgtcggtatgtcggtggccggtgcggccggccccggtgtcgcgccaccgggggcgaacgtggtattcatcgtcgtgctgctcccgtatttgaggctcgcgcaagcatagcgcgatgtgaagaaccctgtccgttcgatggagttacccgattgtgagcacaaacccgacgaacgcgtcgaacccgccgcccgcctccccgcacgctcgcgcagatggccgatcgtcctgatcgccggcgccgcgttggggctcgtcgcgctgctggtctacgaatacgatgcgcatgaacgcggcaccgacgacgcgtacgtgacgggccacctgcacgtgatctcgccgcgcgtggccggcaccgtcgagcgcgtgctggtggacgacaaccagttcgtgcatgcgggcgacccgctcgtgcggctcgacccgcgcgatttcgacgtgcgcgtcgcgctgcagcgtgcgcgcgtcgcgcaggcgcgcgccgatgcgatgcgcgcgaaggcgctggtcgagcaggccgacgcgacgctcgtgtccgcgcacgccgacgccgagaaggccgaactcgactacgcacgggcgcgcgagctgacccgcgaaacgccgcgcgggctgtcgcaacaggaattcgatgcggccaacgcggcgcgcaagtccgcgcgtgcccgcatcgacgcggcacaagcgcagcagcgcagcgcgcaggccgcatggcaggcggccgacgccgtgtcgcaccagggcgacgccgacttgcgcgatgcagagttgcagctgcagtacacgaccgtcgtcgcgccgacggacggccgcgtcgggaagaagaccgtcgagaccggcgagcacgtcgcgccgggccaggcgctgctcacgctggtcgaaccgcacccgtgggtcgtcgcgaacttccgcgaaacgcagctcaagcacgtgcgcgccggcgatgcggtgcggctgcgtttcgacgcgctgccggacctgaccttcaacgggcacgtcgacagcctgtccccgcgaccggcgggcagtttgcgctgctgccgcccgacaacgcgaccggcaacttcacgaaggtcacgcagcgggtgccggtcaagatcctgctcgacgggcaggcgtcgaccgagccgcgcatccggcccggcctgtcggtcgtcgtcacgctgcaagccggccgagaacagccatgagccgcctcgtcgcgctgctcgccgccggcctgctgggcgcctgcacgatcgcgccgcagccgctcgcgcccgtcccggtcggcaccgaccggttccgccacgcggatgcgcccggcgaaccggccccgtcgctcgccggatggaccgcgtcgttcggcgatgcgccgctcgtcgcgctcgtcgatgcggcgctggccggcaacttcgacatccgtgcggccgccgcgcgcgtcgaccaggcgcaggcgctgctcggcgtgcgcgaagccgcgctttccccactgtcggcgtcgatccgtcgttcaaccgttcgcgtgtgtccggcacggtcgacaatgcgttgccgaagcgcctgatgcacaactggtcggcgccgttcaacgcgagctatgaagtcgatctgtggggccgcctgcgcggcgacgcggaaatcggcaggcagaacgtgctgcaggccgacgccgatcgcgcggccgtgcggctgcgcgtcgcgaccgaggtcgcgagcgactacctgacgctccatttcgtcgaggaagatctggcgacgctcgcccgcgcgatcgagctgcgccgcaccgcgctcgacgtgatcgccgcgcgcgtgcgggccggcgcggcgagcgatctcgacgcgctgcgcgcggcggccgatctcgataccgcgcgcgccgatctcgcggacagccggcggctgcgcgaaaacctcgtcgatgcactcgcggtgctgaccggcgtgtcgccgaccggcttcacggtcgcgccgaccgccgccgcgattcgcgtgccggcggtgccgcccggcctgccgtccgtgctgctcgcgcagcggccggacgtctacgcggcggcacgccgtgtcgacgcggcatcgctcgaaaccggcgttgcccgcaccgcatggctgccgacgctgacgttgacggcccagggcgggttcgcgagccgcgacctcggctcgtttctcgagcgcaacagttcgctgtggggcctcggggcgagcgtggccgaaacgctgttcgacggcggcaagcgcgacgccgcggtagccgccgcgacggccggcacggcgctcgccgacgcgaactatcgggcgaccgcgctgggcgcgctgcgcgaggtgcaggacgcgctcaacgacatcgccgcgcagaacgagcggatcgtgcgctacgacagcgcggcgcgctcgaccgaagcggccgcgcggctgtcgctgagccgctacgcacatggctacgtcagctatctcgaggtcatcgacgcggaccgcgacgcattgaacgcgcaacgccagttgatccacagccgccaggcgctcgcgattgcgacggtcgatctggtgcgcgcgctgggcggcgggtggacgccgccctccgtcgcaccgcaaaacgtcgcgcaacgcgacgaccggctttgaaagatacccgccgtgcggccgaccggtcattctggcggcctcacgaattttcaagttgctcttaagcttacctaacgtttttgtgttgcccggtgcgggcgcactgcctacattgagcgtatcgaattcaccggagcgagacccgtcatggatcgcctgaaaacgctcgagatactcaagacggttgccgagcacggcagcttcacgaaagccgccgagcttcacgggctcggcgttccctgcgtcagccgctcgatccagtgcctcgaaacgtcgctcggcgtgctgctgtttcaccgcacgacgcgcaaggtgacgctgacccgcgtcggccacgacgtgctcgaacaggcgctcgcgctgctggagcaatacgagcacttttccgtctgctgtcacgccaatgcaagcgagatgcagggcgagatctcgatcgaggtgtcgaacctgttcggcgccgaccggctggtgccggcgctcgccgatttcaaccggcaacatccgctcgtacgggtccggatcgactggaccgatcatccgagcgcggcgttgaacggcgcgatggacctgtcgatcgtcacctcacgcacgtcgagtctcacgtgcgtcgagcggcgcctcgggcgcatctcgatgggcctgtacgcaagcccgcggtatcgcgccgcctgcggcgacgcgctcacgccgcaggcgctcgaacgcatgggcccgcacggtggtaagacgggcgccgccgggtcggcatggccgctgcggcatcggcgcagcggcgcaatcgcggagatccgtcttgccggcgcgatcagctcgaactgcctcgacacgctgattctcgcgacggcccgcggcacaggtttcgcggtactgcccgagcatcttgcccggccgctcgagcgcgacggcgcgctcgttcgcctgctgcccgactggcaggtcggcgatctcgatgcatcgctgctctatcactcgcgccgcaatctgcccgcgcgcatccgtgcactcgccgaccatctcgtcgccgcgttcgacggtacgccagccgcgcggccggccgtgcaacacgacgtgcgcgcggtcacgcaagccacggtcgctggcaacacggtggccgcatgagggccgccgtcgtcatcgtcgcgacgcggcccgccacatcgaaacccacaccgttgcgccgccaggccggccccgcgcgctcagtcgcgcgcgccggccgggcgcacgcccagcgcatcggcctgccgcacgagatccggcagcgtgcgcacccgcatcttcttcatcacctgggcccgatgcaccttcaccgtgatttcctgaaggccgagattcgcggcaatctgcttgttcatcaggcccgcgacgacctggctcatcacttcgcgctcgcgcggcgtcaacgacgcataggcgccgcgcaccgcgtgaagcgtgcggtcgcgctccagcgcgcggccgacggcatcgagcattgcctcgtcgtcgaacggcttcgtcaggaaatcgagcgcgccgcccttcatcgccttgaccgtcgtggccacgtcgccgtaacccgtcatgaacaggatcggcacgttcaggcccgcccgcaccgccgcctcctggacggccagcccgctctcgtcggcgagccgcacgtcgaggatcaggcagctcggcacgtcgggccgctcgaacgcgagaaacgcgcgcgacgacgcgaaggtttccacgcgaaatcccgccgaacgcaacagcgcgctcaacgcgcgccgcaacgtttcgtcgtcgtcgaccacatagacgatcggcgcgggttctcccgcgccgccgttgccgctcgacgtcatgtccggcgtactcgccattgcattccctgtgtaggcatccgcttcattatcaaatgataaactaacaaaatgccgggcggaaccgccacgcgtcggacggcgcggccggccggcggagcgccgctcacgcgggcggcgtgccggatgcgacctggtcgatcaggttgagcatgtcgtctgacggaaacggcttgcgcaggaacgcgatcgcgccttgcgccagcgcgcggcggatcgattcgtcgtcgccgtgcgccgacatgaagatgaccggcagcgtcgcgttgcgctgaatcagctgacgctggacgtcgagcccgctcatccctttcatcttcaggtcgaccagcacgcaaatcgcgccggccggcgcatcggccgccaggaattcctcgcccgacgcaaacggcaatgcagtatggccagccgatttcagcaggctggcgagactcttacggaccgacgcatcgtcatcgatgatgcaaacaatggccatgaaatgagaacctgaaaattgtgtcaatccagtacagcgtgatgcaacgcggggccgcgtcgaccggcgtcgccccgcccccgcgatccgtgcgtcatgcccacggcgccgcggccagccgcggctgcgcgggcgcggccggcgccggcggacgcgaatccgcgcgttcggcggcggtgaacgacgcgcaccgcgcatgcacgcggcccgcttccccgattccgccagcttctcgagcgcatacgcgcgcacgacctcgagcagcgaataacgcttcgacagcccgaccgaatgaacgaccagcaacgatttcgacgcgagactgacgagacagtcgagcacgcgtgcgccgccgagttcgtcgcacgcggcgagcgcgcacgccgcgtcgagcgggaacgcatccggaaacaccgcgaggcggcacagcacggtgcgttccgcgtcgtcgagcagccggtagctccactcgatcgtggcccgcagcgtctgttggcgcggatgggcggtccgcaggccgccggacaacgacagcaccgacttgtcgagatcggcggccagcccctggatcccgagcagcgcgacgcgtgccgcgccgagttcgagcgcgagcggcaggccgctcaggcgccggcagacggtcgcgatcgcgtccagcgtcttcgcatccgcgggcacgtcggtgcccatcgcgcgcgcccgcgccaggaacatgcggacggccccgcacgcgacgatctcgccttcggtcgcgccggccggcggcacgggcagcggcccgacgcgatacacgcgctcgccggcgacccgcagcggctcgcggctggtcacgacgaggatcgcgccggcattctcgtcggcgatcgcttcgcacaggtccgccagttcgccgacatgctgctccgcgttgtcgaacaccagcatcacgcgctgcccgccgatcgcgcgcacgacgtccgcctgcccggcggccgagccgcccggcaggccgagcgcgcccagcaccgcggactccagcgtcgcgcctcccggccagccggccaggtcgatccggaccatctcgatgccgcgcacggccgaccacgcggcggcgacctccagcgcaagatgcgtcttgccgacgccaccggggccgaccagcgtgacgaacgcctcgcgttcgagcagcgcgtgcagctcggccgcttccggctcgcggccgatcagcggacacttgcgcggtgcggcacccgtgcggacgctgcgcaccggctcgagcgcgtccggcaggcggccggcatgggctgcatgggtggcatcgaccggcggcgcgagccggtagccgcggcccgactcggtccggatccagccgtgcttgccgccgaacagcttgcgcagcgtcgagatgtgcacctggatgttgttctcgacgacgatcgtgtccggccacacggcctccatgatctcgtccttcgacacaagcttgccggccgccttcaccagcagctcgagaatctcgaatgcccgcgcaccgatataccggggctgcccgtcgacgcagacttcgcggcactcaagggaaaccgtcacccgcccgaacgtatacatgatccgcacccgccttatgctgctccgcatcgtgcgccgcccagcgaggcgacacccctgttccgcccgtccggtcgcatcgatgcgggccggcaggcatgaccctatcgtatggggtcgcgcgcgtgccggccattatctattggtttagtgggacgctacccgcgcgccggcaaccccgggagggggtactgcagatttccgcgggctgtcggacaatgcccgggcatgccgcgcgtgcgatcgtgcccggccgctgcctgccgacatgccgttgcgtcccgttccatccagcctgccctcatcgtgaaccaacccttgcgtaagcccgacgacacgaaccgaatggatgccgactggctggcacgcgcccgcctgtcgaacgcagtccgcgcagacgacgtgctgtacttcgacctgaccgacgccgagaccggacgcgtgtggtccgcgtgccggaccggctgggaatccgacgggcgctgccggcaattcgagcgcgagtacgcattgaacggcgtgctggatccggcatgggcgctgctgccggccgcgctgatccgcgcggcggacggcccggtgctcatctttccgcgtgtcgacgggcgcgcgttcgacacgctcgccgacgcgcagctgccgctcgacgcgtttctcgacacggcgatccacgcggtgcgcacgctcggcgcgctgcatcgcctcggctggctgcacggcgacctgcaaccggccagtttcgtcgccctgcccgacggcacggtcatgctgcgcgcgttcgcgcatgcgcgaaatcgtcggacggaacacgccgcggcggagccgctgcgcgcggaattcgccgcgtatgcagccccgaagtctccgagggtgcggacatcgacgaacgctccgacctgtatgcgctcggcatcacgctgttccgcctgctgacgggcgcactcccgtacaaggcggcgtcgacgtccgaatgggtgcacgcgcacgtcgcgatgcagccgtcgccggccacggggctgcgcaacgacctgcccgcgatcctgagcgacctgctgctgaagctgatcgcgaaggagccggccgagcgctacccgtcctgcgacgcggtacagcacgatctcgaacgcatccggcgcgactggctggcagccggccgggtcgagccgttcgcgctcggcggcagcgatccgctcgccggtttgcgcacgcccgaccggctggtcggccgggaagccgaatcgcgccggctcgcggccgcgctggccgcggtccttcggaccggcgaggcggccatcgtcctgctggacgggccgcccggcgtcggcaagaccgcgctgaccgaggacttcatgcgcgcgtcgcgcgcgacatcgcgtacggcctggtgcacgtcggcgaaggtcgaccggttccagccggcccggccttacgcgccggtgctggcggcgctgcgcgcgctgttcggcagcgcgctcgcccggcgcgacgacgaaatcgccgcgatcgtcgcacggctgcgcgcgtccatcggcgcccaggccagcctgctgtcccgcatctttccggagatcgcgtggctgctcgatgtcgagcccgtcgcgttcggccataccgacgcgatcccggagtttcatctgtgccgcatcgtcgtgaacgcgttccgcgccttcgcgacaccggccgagccgctggtgatgacgctcgacgacgtccagtgggccgacgacgcgacgctcgcgttcctcgcgtcggtcgcgctcgatccgccgccccacgtgtgcatcgtcgccggttatcgcagtgggtcgcagcacgatcacccgccggcgttccgccgcttcctgcagcagctcgcccccgcgcgcgtgtcggcgctgacgctggcgccgctcgacgcgcccggcgtcacgcacatgctggccggcctgctcggagaagcgccggaccggctgtccgcgctcggcgacatcgtgacgcggcggaccggcggcaacccgttctacgtacagcagttcgtgcgcacgctgatcgacgagcaactgctcgcctacgacccggtgcggcggacatggcagtggcagccggccgacctcgacgcgcaccacctcgccgagaatgtcgtgagcctgcttgccgtgcgcatccagcggctgccgcatgaatccagaacgctgctgtcgctgctggcctgcatcggcaccgatgccgacgtcgcgctgttgtgtgccgccgccggcaagacgcgcgccgaactcgcgttctggatggaccccgtgcgccaggccggcctcgcgtcgcacgccgatgaccgctggcgttgcgtgcatgaccgcgtcatcgagtccgttcacgcgctcgccgggcgggcggagcgcgcgcagtgccacgcccggatcgccgctgcgatgctggcgcgcccgggtgcccgggcgaccgaagcgctgctggaactggccgcccagatcgagcaggcgcgcaccgcgccgctcgaccgcacgctcgcgctcgccttcgcggacgcgctggtcgcagccgcggaagcggcggccacggtcgccgcgcgcgatcgcgcgctgtcgtttctcgcgtgcgcgcagacgctgctcggcccgcacgcgtgggtgcagcattacggtctcgcgagccgcatcggcatgctgcgcggcggcctgctgctcgcgaccggcgccaccgcgcaggcatcgagcacgatcgacgaactgatggcgcgcacgcgcacgccggccgaccgcgccgaggcccaccggctgaaggccgcgcagctcacggtcgagtcgcgctaccggcaggcggtcgacgtcgcgctgcagggctggcgctgctcggcgtgacgctgccggccgcgccgaccgccgccgatctcgcggcggccggcgacgccgtgcgcgacgcgctcgccggccgtgcgatcggcgatctggtcgggctgcccgtgatgacggacacgcgcgtcgaagcgacgatggccctgctgaccgcgctcgaagccgcgatgttctatccgagcggcgggctgccgctgctgcatttcgcgacgatggtccggctgacgctgcagcacggcgtcaccgccgcatcggtgcaggggctcgcgtggtacggcgtgagcatcgccgagcatcacggcgcgtatgaagacggcttcgaattcgcgaaggtcgcgctcgcgctggtcgatcgacacggcttcgagcgctaccgctcggcgacgctgatcgcgctcgaccaggtgagcgtgtggacccagccgctgtcgtacgcgctcgagcgcgcacgcgaagcgaaagcggccggcaatgcgagcgccgagctgcgctggatgtgctacagctgcaaccacatcgtcagcgacctgctgtcgatgggcgaagcgctgccggcgattcgcgacgagatcgatccgttgctcgcgatcgcgcgcggcgcgcgctacgacgacatcgtcgacctcgtgtccacccagtcggaattcgtcgacgcgctgcagttcggctacgaccggccggtcggcacgtggcgcatgcgcgtgtcgacgaaaacgccgatgtcggtcctgcagttctggaccgacgtccttgcgggccaagcggcgttcatcttcggcgatgcacccgcggcacgcgcgtcgctcgacgcggccgcggcaagcgcgtggtcgacgcccgcgcacatcatgacgtccgatttccacctgttcagcgtgctcgccggcatcgcggccgacggcggcgcgacgccgcccgggccgctgctcgaacgcttcgcgccgcagcgcgcgcgcttcgccggctggagcgcgcggaatccggcgacgttccgcaacaagctcgcgctgatcgacgccgaattcgcgcgcgtgcgcggcgaccacgtcgcggcgatgcagcagtacgacgcgtcggccagcctcgccgcggaacggggtttcgtgcacgaacaggcgcttgcgcacgaactggccgcgcgccacgcgatgtcgctcgggctcaccggcccggcgcgccatcagtggcggctcgcgcatgcgtgctaccggcgctggggcgcgaccggcaaggcgcaggcgctggaagcgcagcacacgttcctcgtgatggagccgccgccgggcggcgcggccgtgcccgcgcgcgaagacctcgatttcgcgctcgcgatgcgcgcatcccattcgttatccgaggaaatcgtgctggagcgcctgatccagacgctgatgcgcaacatgatcgtgtacgcaggcgccggctacggcctgctgctgctcgcccgcaacgaccggctgacgatcgaggccgccgcgcggatcgtcgacagcgacgtggtcgtcgagatcgcccgcagcgaacccaccgagcacgatgtcccgctgtcgatcctgaacaccgtcgcgcgcacccgcaagccggtcgtgctcgcgaacgcgcagcgcgagggcctgcccgaccacgtcgacagcctgcgcgcgcaccccacgcgttcgctgttctgcctgccgctgctgaagcagggtgtgctgatcggcgtgctgtacctggagaatgcgctgagcaacggcgtgttttcgccgcgccgcatcgcgatgctcgaaatgctcgcgccgcaggcggccaacgcgctggagtccgcgcggctgtacgcggaactgatcgacgaaaacgcgcgccggctcgaaaccgaggccgcgttgcggcatgcgcgcaccgagcttgcgcgcaccgcgcacatgaccgtgatgggcgagctggccgcgtcgatcgcgcacgagatcaaccagccgctgacgagcatcgtgtcgagcgccggcgcgggcatgcgctggctgcgctgcacccgcccgatctcgacgaggcgctcgcgagcctcgacgacatccgcgcgtccggcgtccgcgcggccgacatcgtgcgcgcgctgcgctcgctcgcccgccaggcgccgcccgcgctcgcgccgctcgcgatcgacgacctgatccgcgacatgctgcacctcaccgcgaccgaaatcgacgcgaagcaggtcgcgctgcgcgtcgacctgcattgcgccgcgatccgcgtgatggccgatcgcacgcagatccagcaggtgatcctgaacctggtcaccaacgcgctcgacgcgatggacgggcaggccgcatcgcgcgaactcgacatcgcgtcgcaggccggcgacggctacgcgaccgtctccattgccgaccgcggcgcgggcatcgacgccgggatcgcgaaccggatcttcgacgcgttcttcacgacgaaatcgaacggcatggggatgggtctcgcgatctgccgctcgatcgtcgaagcgcacggcggcacgctcgaagccgcgccgcgcggcgacggcgggtccgtgctgacgttccggctgccggtgtcgacggcgggctgacgcaagcgaccggcgcgggccggcacccgcgccgcgcaattcaggttccgctcggccggtgcgcgtcctcgccgaggaaccggtgcacgaacgtgacggccatcgccccttcgccgaccgccgacgccacccgcttgaccgaccccgaacggacgtcgcccgccgcgaacgagccgggcacgctggtttccaggtagtacggccggcgctcgagcggccacacgcgcgtgaagtccgggcagtcgtacaggtcgctgcccgtcaccaggtagccgcccggattgcggatgatgtcggtgtcgcgcgcccattcggtgttcggcgcgccgccgatgcagacgaacaggtgcgtagccggcagcacgtcgcgcgcgccgtcttccgtgcgcagcacgatcgcctcgagccggccgtcgccctgcagcgcgtcgacggtcgtgccgtagcgcaccgtcacgttcggcatgcgctcgatccggtcgatcaggtagcgcgacagcgtcgccgcgagcgacgcgccccggacgatcatcgtgacttcgcgggcgtgccgcgcgaagttcatcacggcctgcccggccgaattgccgccgccgacgatgaacacgtgcttgccctcgcacatcggcgcttcgctcgatcccgcgccgtagtacaggcccgcgttgagaaacttcgattcgtcgggcaggccgagactgcggtattcgatccccgtcgcgcagatgttcgagcgcgcggtcaggatcgagccgtcggccatgtcgacgcggatcttgccgtcgacgaacgttgcgtgcacgccctcgcgcatcatcagcaactcgacgccgaacttcaccgcctgctggcgcgcgcgctccgccagctcggcgcccgggatgccgtccggaaagcccatgtagttctcgatcagcgaactcgtgcccgcctgcccgccgatcgcgtcgcgttcgatcacgacggcccgtagcccctcggacgccgcgtagacggccgccgacaggccggccgggccggcaccgtaaatcgagacgtcgtactcgatgaagcgtggccgggagacccagccgagcttcgcggcgatctccggcagcgtcggctggtagatgcacgtgccgtccggaaacacgaccaccggcagccggacgtcgcgcagcggcgcgatgcccagctcgcgcacgcaatcggtgtcggacgtcagctcgcaccattcgtactcgaccacgccgcgcttcaggaagtcgcggatcgcgtaggcctccttgctgtgaggcaggccgatgaccttgacatgctgcgactgcgccatgagcgtctcccggtgaccgcgtgtcggatcccggccggttcccgcgccggccgcacgtgtgactgtacgtcgtcatcgccgccgcggccgccgcgtttcataagaattaaggttcgcgcgcgatgcgcgccgtccacaatgaatcgggttcccccgctcgcagcttcgcgccggccgcgctgcgagcgcccccggcgccggcatcggagcgacagatggccacgacctgcacccatctcggtgaagcgcgcatcctgaacaccgacaaggactactgcgaggaatgcgtgaagtccggcagccgatgggtgcatttgcgcctgtgcctgagctgcgggcatgtcggctgttgcgactcgtcgccgaaccgtcacgccagccggcattttcatgaaacgacacacccgctcgcccgttcgatcgagcccggcgagcgctgggtctggtgctatgcggacgacgtgatggccggcgaaatcacgccgtaacccgccgcgcacctctatccggcaccgttttcgaccgagggtatcacggttcgatcgcggcttcttctcgccgctttttcgactagtatttatcgaacgataacttatctatcgataaacaagaggttcgtcatgacggtatccagactcgcgcactactcgatccgcacgctcgatctcgagcgatcgtgccggttctacgaacgtgtgctcggcttcaaacgcggctaccggccgccgttcgactttcccggcgcctggctctacaagggcggcgacgaaagcgattacggcacggtccacatcatcggcgtcgacccggccaacccggacgggctcgcggcctacctcggcgacaaggcgctgccggcgtcgggcaccggcacggtcgaccacatcgcgttcctcgcgaccggcgtcgaggcgatgtgggacacgctgcgcgccgaacacgtcgcgtggcgcgatcgcaccgtgccgagcctcgggctgcaccaggtgttcatcgaggacccgtccggcgtgacgatcgaactcaacttcccgccgccgaagtcgcggggctggcactgcccgccgccgtaccggccggcgactcgcaagaacacggagactgacatgaaccacggcacttcgaccaaacgccgggccgcgatcgtcggcggctcgctgggcggcctgttcgccgcgaatctcctgctgcgcaacggctgggacgtggacgtgtacgaacgggtgcccgacgcgctgtcgggccgcggcgccgggatcgtcacgcaccccgaactgttcgacgtgatgcgcgccgcgggcgtgcgcatcgacgcatcgatcggcgtgaaggtcgagtcgcggatcacgctgggccgcgacggcaacgtcgtatcggaacgccggatgccgcagacgctcaccgcgtggagcaagatgtaccacgtgctgcgcgcggcgctgcccgaccagcattaccgcgcgggcgcggtcgtcaccgacgtcgcggacggccccgggcacgcgtcggtcacgctcgccgacggctcggtcgtgcatgccgacctcgtcatcgcggccgacggcttccgctcggcgatccgcgagaaattcctgccggacgcgcggctgcaatatgcgggctacgtcgcgtggcgcgggctggtcgacgaacccgggctgtcggagtccacccacgcgacgctgttcgggaatttcgcgttcggcctgccgccgcacgaacagatcctcggttatccggtcgccggccagggcaacagcacgaagccgggcgagcgccgctacaacttcgtgtggtatcgcgcgacccgcgaggacaccgacctgccgaacctgctcaccgacgcgaccggcaagctgtgggcgggcggcattccgccgacgctgatccggcgcgaggtgctcgacgacatggaagacgccgcccacgcgctgctggcgccgcagttcgccgaggtcgtcgcgcgcgcgacgcagccgctgttccagccgatctacgacctcgaagtgccgaacatggcgttcggccggatcgcgctgctcggcgacgccgcgttcgtcgcgcggccgcattgcgggatgggcgtcacgaaggccgccggcgatgccctcgcgctcgtcacggcactcgccacgcgcgccgacacgctcgacgcgctgtgcgaatacagcgagacgcgcacggcgttcggcgcggcgatcgtggagcacgcgcggcacctcggcgcctacatgcaggcgcaactgaagaacgacaccgagcgcgaaatggccgagcgctatcgcacgccggaagtcgtgatgcgggaaaccgccgtcccgccgcatttctgagcacgcacgggcgccgtgcgcgacacgcgcggcgcccgtcgccaagccatgccaggccattccagacgagaaggagacaccgtgaaccacccgctttcggctaccgccggcaccgcgcccgaaccggccgcaccgtcacatgccacgcatccgctgctgcgcgatgcccgctttcgcgagcacgtccggcgcagaaggctgttcgcctggtcgctgacgttcgtcatgctcgccctctatttcgcgttcatcctgacgctggcgttttcgccgacgctgctgggcgcgccgatcgtgccgggccggccgactccgtggggcatcccggtcgggttcggcatgttcgtcgcaacgttcgcgctggtcgcgctttacgtgttccgcgccaatgcggtgcacgacacggtcgtcgcggcccttcgccacggagacgcatcatgaagcgcctgctccctgcactgctcgccgcttgcagctgtgcaccggcgttcgcggccggccccgccgcgctcgcccacgggcacaatccggtcgcgatcggcatgttcgtcgtgttcgtcgcgtcgacgctcttcatcacgcgctgggccgcgcgcaagaaccacagcgtggccgaccactacgcggcgggcggcaagatcaccgcgttccagaacggctgggcgatcgccggcgactacatgtcggccgcgtcgctgctcggcatctccgcgctggtgttcacgagcggctacgacgggctgatctattcggtcgggtttctcgcgagctggccgatcatcctgttcctgatcgccgagccgctgcgcaacctcggcaagtacacgctcgccgacgtcgtgtcgtatcgcctgcggcaacggccgatccgcgcgttcgcggcgtcgagctcgatcgtcatcgtgctgctgtatctcgtgtcgcagatggtcggcgcgggcaagctggtcgagctgctgttcggcctgaactacacggtcgcggtgctgatcgtcggcgtgctgatggtcgtctacgtgttcttcggcgggatgctggccaccacctggatccagatcatcaaggccgtgctgctgctcgccggcgcggcgttcatggcgatcatggtgctgagccgtttcggcttcagcctcgacgcgctgttcgcgcaggcgattctcgttcacccgaaacacgcggcgatcatgcgccccggcgggctggtgtccgatccggtctcggccgtgtcgctcggcctcgcgctgatcttcggcaccgcgggcctgccgcacatcctgatgcgcttcttcacggtcggcgacgtcaaggcggcccgcaagagcatcctctacgcaaccgggatcgtcggcgccggctacgtgctgatcatcgtcatcggcttcggcaccatcgcgctcgtcgcgtcggacccgcggtaccacgacgcgtccggcgcgatcgccggcggcgcgaacatggtggcgatccacctcgcgcacgcggtcggcggcaacgtgttcctcggcttcatctgcgcggttgcgttctcgaccatcctggccgtggtcgccgggctcacgctcgcgggttcgtcggcgatctcgcacgacctctacgcgaacgtgctgcggcgcgggcaggcgtccgaccgggacgaaatgcgcgtggcgcgcgccacgaccgtcgtgctcggcgtgctcgcgatcctgctcggcatcgcgttcgagaagcagaacatcgcgttcatcgtcagcctcacgttttcgatcgcggccagctcgaatttcccggtgctgctgctctcgatctactggcgcgggctgacgacgcgcggcgcggtgctgggcggcctgctcgggctcgccaccgcggtgacgctcaccgtgctgagcccgaccgtgtgggtccaggtactgggccatgcgcacgcggtctatccgtacgaatacccggcgctgttctcgatggcggcggccttcgccggcgtcgtcctgttctccgtcaccgatcgctcggcgcgtgcgcaacgcgagcgcgcgcagttcgacacgcaactcgtcgcgtgcgagatgggcctcacggcgggcaccaccacgaccatcacgcaacgcggctgaaccgcacgtcacgcaccccgatacaccatgagagacaccatgctgaattgcacctgctgcccgtcgccgggacgccgccgcctgctcggcgcgctcgccgcgttcgcgggcaccgccgtcgccggacagtccgcgtcggccgccggcagcgccggcaccccggccgcgctgccgccgcaccggccgcgctcgatcgacatccacgcgcattactacccggagagcttctgcaacctggtcggcggcgaaggcaagcgcttcggcggctcgttcgtgtgcgacgacacgtcgttcacgttccgcacacccgccggcggcctcggcccgctgccgatgaagttcatcgacatcgatgcgcggctcaaggacatggatgcgtccggcgtcgacgtgcaggcgctgtcgctcagcgtgccgatggcgtactggggcgaccggccgttcaacgcgaagctcgcgcgcgactggaatgcatcggcgtcgcgcgtctaccagcgacacccgacgcgcttcgtcgtgctcgcgacgctgccgatgctgaacgcggccgacgcgatcgacgagctcgaacgcgccgcgcaattgccgggtgtgcgcggcgtgtacatgggcaccaacatcgacaaccgcgatctcgacgatccgctgttcgcgcccgtgttcgcccgcatcgagcagctgggcctgccggtgttcctgcatccgcagcagacggtcggcggcgcgcggctcggcgatttctacctcagcaacctgctcggcaacccgttcgataccgcgatcgcgggctcgcacctgatcctcggcggcgtgctcgaccgctacccgacgctggagatcacgttgccgcacgcgggcggcgcgctgccgatcctcgtcgggcgcctcgacgcgggctggaccgtgcggcccgaaacgcgccggctcgcgcagaaacccagcagctacctgcggcgcttcagctacgacacggtgtcgcattcaggccccgtgctgaacttcctgatcgagaacgtcggcgtggaccggctcgtgctcggcagcgactactgtttcgacatgggctacgagcagccggtgcgctttctcgaccgtgtcgacctgagcgcgcagcagcgcgcgatgatcctcggcggcaatgcgggcaagctgctgcggatctagcgggccggcgcgcggcgcttgcaccgtcggcgcagcccgcggccggacatggcaagatccgcagcagccgtggccgcaggcgcgcggcgccgtgcatcacgacgcctggccgacggcgcacgccatcggccgcacaccggagtcacccacgatgaagatagtcattgcaggcggatcgatcgccggtctcgcggccgcgctgacgctcgactgcgtcggacacgacgtgacggtctgcgaacgctcgccgtcgccgctgcgcggccagggcggcggcgtggccgtgttgcgccggatgatggcgtttctcgaacagcatggccggcattgccgccacgcgatcagcgtgccgacacaccggcggcgctggatcgatcgcgacggcatcgtcacgcgcgacgagcccgagatgctgccgttttcgtcgtgggacgccgtctaccgctcgctgtgcgaaacgctgccgcacgggcgcatccggtacggccgcacggtcaccggcttcgaccaggacgccgacggcgtcgacgtccacctcggcgacgagcgcctccgcgcggacgtgctgatcgccgccgacggggccggctcgaccctgcgcgcgcagctctttcccggttacgcgccgtcgttcgccggttacctcgcgtggcgcgggatcgtcgacgaagcggatttcgacgccgcgtcgatcgcgccgctggtcgagaacatgacgctgcacaaggcgccgggcgagctgttcatggcgttcctgattcccgcgctcgacggctcgctcgtgccgggcacgcgccgcttcaactggctgtggtatcgcaacgaagccgatcgcgacgcgctgcgccaccacctgaccgatcgggccggccacgcccatcacgcgtccgtgcatccggggcagctcgccgacgacgtcgtcgcgacgctgcggcaactcgccggcgaacgcctgccggccctgctcgcgcaactggtgcacgcgacgcgcatgccgttcaaccaggcgatcttcgatgcgttgagccccgcgttcgtcgatggccgcgtcgcgctgatcggcgatgcggcgtgcaccgtgcgcccgcataccgcatcgggcacgtcgaaggccgcgagcgatgcggtgtcgctcgccgaagcgctgccggcggacgcgaccgacgtcgtcgcgcgcctcgcgcaatggtcggcgcgacggcgcgacgacgtgacgtcgctgctcgagaagggcccgcagctggccgcggcgttcggcctcggcacgccgcgctgacgcggcggcgcccgcgccgggccgcgtcgcggcggagttcagaacgtttcagcgcagtttcaggaaatgccgccgacgcccacgtagactgccctccatcatccgcctcgcacacgatgacgcgattgcgccattgcccgcgcggcctccccatacctggagcaacgacatgatctccgccgcgaaccgctgccaccgggccgcctcgccatggccggatcgcccggcgatgcgccgccgtcatccggccgcgccgaccggaacgaccgccgccggcacgcgcgagcccgaccttccatcctgccccgcgtgccgcggcagccgaacccgcgccgtcgcgcgcggccggcatccgcgccattgccccgccgctcgaatgatcgccggcgaaccggttcgcgtggagcgcgcatgaagcacaaacgactctggttcggcgcggccggcatcgcggtcgtcggcctggcggtcgcgatcggcatcatggtcaagccgtcgatcgcgccgatcgatccgcccgcccgcgcgtcgttcgatccgcaactcgttcgcgccggcgcgcgcgtggtcgcgctcggcgattgcgtcgtgtgccacaccgcgaacgacggcaagccgttcgccggcgggctgccgctcgcaacgccgttcggcacgatctacgcgaccaacatcacgccggatgccgacaccggcatcggccgctggtcgcgcgatgcgttcgcacgcgcgctgcgcagcgggatcgcccgtgacggccatccgctctacccggcatttccgtacatccacttcacgcggatgtccgacgacgacatcacggccgcctatgcgtacctgatgacccgcgaaccggtgcggacgaagacgccgccgaacgacctgatcttcccgctgaacttccggccgctggtcgcgttctggaacgtgctgttcctgcgcgaaggcgcgtaccggcccgacccgtcgcaatccgcgcaatggaatcgcggcaagctgctcgtcgacggcctcgggcactgcgcgtcgtgccattcgccgctcaatgcgatcggcggcgaacaggccggcaaggcgttcgacggcggcatcgtcgacggctgggaggcgccgccgctcaatgcgctcggcagcgcggtcaagccgtggacgcaggcgcagctcgtcacctacctgcgcaccggccgcgcgagcgagcacggcgcggcggccggcccgatgctgcccgtcacgcgcgatctcgcgaccgtgccgcaggaagacgtcgaggcgatcgccgcatacatcctgtcgatccagaagccgccggccgcccggcccgcgacggccggtgccggacacggcccgacgacgcccgccggccagcgcggcgcggtgctgttccaggcgtcgtgcgcgcagtgccacgggccggcagcgccgatgcagtcgatcggcgagcggccgacgctcgcgttcagcacggccgtcgccgccgatacgccgcgcaacgcgatccagatgatgttcaacgggatcggctggcacggcgaagacacgctgaactacatgccgtcgttcatcgaccagtacgacgacgcgcagatcgcggacctcgccgcgtacctgcgggaaacgtattccgatcgtcccgcgtggagcggcgtcgacaccctggccgcgaagctcagaaaggaggacagcgcgcgatgatcaccctcaccgtcaacggcgtgcggcacacgctcgacatcgatccgtccacgccgctgctgtacgcgctgcgcaacgacctgcacctgcacggcgcgaagttcggctgcggcctcgggcaatgcggcgcatgcaccgtgatcgtcgacgacaagccgatgttctcgtgcctgattccggtgtccgcgctcggcgagcgccgcgtgcggaccctcgaaagcctcggcaccgccgggcatccgggcaagctgcagcaggcgttcatcgatcaccaggccgcgcagtgcgggtattgcatcgcgggcatgatcatgcgcgcgcaggcgctgctcgaacgcaacccgaaacccaccgaacacgaactgcgcacccagatggaaccgaacctgtgccgctgcggcacgcacatgcggatcctggcggcgatccgccaggtcgccggcctgcccgacccggagccggccgccgcacccgtcatgatcagcaagggactctgatgaacccacccgacgacatcgacgaaagccgccggcacttcatggtttccggcgcgctcttcgtcgcgttcagcctcgcgccggtcacgcgtgccgccgcgcagctcgtgatcgcggacgaaggcgccgccgtccacgtcgccaaggcgaccgaaacgctggccggcagcctgaagaccaacccgctgctggacgcatggatcaagatcacgcccgacggcaaggtcaccgtgttcaccggcaaggtggagctcggcaccggcgtgcggaccgcgctgctgcaggtggcggccgaggagctgaacatgaagccctcgctgatcacgttcctgacggccgacaccggcgcgtcgccggacgagggcctgacggccggcagccacacgatggccgacagcggctccgcattgctgaacgcggccgcgcaggtgcgcgggctgctggtcgacggcgcggcgaaacagttcggcgtcgaggcgcgcacgctcactgtcgccgacgcggtgatcaaggcgccggacggccgcacgatgcgctacggcgacgcggtgcgcacggtcgacctgcaccgcaacgcgacgccgacgtcgccgctgaagccgccggccacgttctcggtgatcggcacgtcgctgccgcgcgtggacattccgaacaaggtcacgggcggcgtcagctacgtgcaggacatggagctgcccggcatgctgcacgcgcgtgtcgtgatgccgcccgtgtacgacgcgaagctgctgtcgttcgacgaagccgcgatcctgaagatgccgggcgtggtgcggatcgtgcgcaacggcagcatgctcgcggtcgtcgcgcagggcgaatggcaggcggtcgtcgcgcagcgcgctggccgccggcagccgctggtcacccggccgcgcgctgcccgagcgcggcaccgtgcaccaggatctgaagcggatcgcgacgcagcgcatcgagatcgcgaacacgaagggcaacacagcgccggccacgaagacgctgtccgcgacgttcctgaagaactacctgctgcacggctcgatcgggccgtcgtgctcggtcgcgcatctcgagaacggcatgctgaccgtgtggacccactcgcagggcgtgtatccgctgcgcgacgcgctcgccgagatgctgtcgatgccgaaggcgaacgtgcgctgcatccacaccgagggttccggctgctacgggcacaacggtgcggacgacgtggccgcgcatgcggcactgatcgcggcggcgctgcccggcaagccgatccgcgtgcaatggatgcgcgagcaggaacatacgtgggaccacttcacgcccgcgatggtcaccgagctcagcgcgtcgctcgacgcgagcggccatatcgtcgactggaactacgcgctgtggagcagctcgcacaacgaacggatcgtcaatgccggccggctgctgcccgcgcggatgctcgagccgccgttcgtgcccgcgccgtcgacgccgatgctgcagcccgagggcggcggcgatcgcaacgcgatcccgctgtacgcactgccggccatgcacatcgtcaacaacttctcgccgacgatgccgctgcagacctcggcgatgcgctcgctcggcgcgcacaccaacgtgtgggcgatcgagagcttcatggacgagctcgcgcacgccgccggcgtcgatccggtcgaattccggctgcggcacttgcaggatcaccgcgcgagccaggtgatcaagctcgccgcgacgaaattcggctggccccggccgccgcgcgaacgcaaccgcggcgtcggtttcgcgttcggcaaatacaagaacctgatggcctacgtcgcgatggcggtcgagatcacggtcgtgccggaaaccggccatgtgacgctcgagcgcgcggaagtggccgtcgacgcgggccaggtcgtgtcgccggacggcatccgcaaccagatcgaaggcggcatcgtgcaggccgcgagctggacactgtacgaggcgctgaaatacgatacgcagcgcatccgcagcttcgactggagcagctacccgatcctgcgtttcggcacggcaccgcaaagcatcaaggtgcacctgatcaaccgcccgggcgcgccgttcctcggcgcggccgaggcgtcgatggggccgaccgcgggcgcgctggccaacgcgattttcgatgcgaccggccagcggatgcgcgaaatgccgttcgcgggcgacgggctcaggaagcgcatcgacgcgtagcggcggtaccccgacataaagccgcgccggcatgcaccggcgcaggcaacgaacaggctggagagttccgaacgatggataccttgctttcgatgcgcgtgttcacgcgcatcgtcgaaacgggcagcttcacgcgcgcgtccgacacgaccgggctgacgacgccgcgcgtctccgcgctgctgagcacgctcgaacagcatctcggctgccggctgctgaaccgcaccacccgccggatctcgctgaccgaggacggacaggcctactacgagcgctgcgtcggcgtgctgcgcgagatcgacgacatggaggcggccgtctcgcaggcgcgcaacgtgccgcgcggccgcctgaaggtgaacctgccgccggcgatggccaagcagatcatggtgcccgcgctgcccgagtttctcgccgcgcatccgggcatctcggtcgaactcggcgtgaccgaccggcagatcgacctcgtcggcgaaggcgtcgattgcgtcgtgcgcatcggcgcgctcgacgactcggggctggtcgcgaaacggatcggcagcctgaccacctgcacgtgcgcggcgcccgcgtatctcgagcgctgcggcgcgcccgaaacggtcgacgatctcacgcagcacatcgcggtcagccacatgtcggccgatacgggccggccgcggccgtgggactacgtggtcgacggcgaaacgcgcatcatgcagatgtgcggcacagtcgcggtcaacgatgccgacacctacatcgcatgcggcctcgccggcatcggcctgatcaagacctcgctgtacctggtcgagccgtacctgcaatcggggcgcctgcgtgaggtgctgaccgatttcaacacgccgccgcggccgatctcgatcctgtatccgcccaaccggcatacgcccgtcaagctcaaggtgttcgtcgactggctcgccgggctgttcgcgcagattccgacgctgcaggggcagcgccgctgacgcccgccgtcgatgcccgtcgctgaaaccgcgcggccgcacccgcgcgcaccccgcatcgatcaagtgaattaagacgcggtttaggactattcagtccgcccgatccagactgctctcagggaccttgcgatccgcgatatccgcgccggaggcccgtttcgagaggcccgacatgacgatcgcgatcgccggcccgtccgtccaggacgttttcgatgtcctcgaccccgcgttcgcgcacgggccgcatcgcagcggccgccctcgccctcgccggcatgcggctcgcgaccggtctcggcctcgccccctcacatgaatccgcacgcgctccgaccctttgcgtggcacgcaaagctcgattgcgcgccggccctattctcttgttatcgctcgatcaataaccttgacggcaatgcggcggcttgcgtttcgccgcggcgaacaccggaacaaccgaacacccgtatcccatcacgcccgcccgacgaccgggcacccgacatctctttcgaaggagtcgaccatgtcagcagaatccaccccgctcgcggcccacgggcacgcagccaagctcacgcagggcctcatcctgctgttcgcgttcagttgcggcgcgatcgtcgcgaacctgtactacgcgcagccgatcaccgaactcatcgcgcccagcctgcacatgtccggcgcaaccgcgagcctgatcgtatcgctgacgcagatcggctatgcgttcggcctgttcttcatcgtgccgctcggcgacctgctcgagaaccgcaagctgatgatcgtcacggccgtcgtgtcgatcgcgagcctcgcggcggcggccgtcgtgcagacgcccgggctgttcctcgcgatctcgctgctgatcggcttcagctcggtcgcggtgcagatcctggtgccgctcgccgcgcacctcgcgcccgatcattcgcgcggccgcgtggtcggcacgatcatgggcgggctgctgctcggcatcctgctcgcgcgcccgctgtcgagcgtggtggccgacgcgttcggctggcgcttcgtgttcgcggccgccgcggtgctgatgacgctcgtgaccgccgtgctcgcgctgacgatcccgtcgcgccagcccgatcaccgcgcgacctatttcgagctgatcgggtcgctgctgcaccttgtccgcacgatgccggtgctgcgccatcgcgcgttctaccagggcctgatgttcgcgtcgttcagcctgttctggaccgccgtgccggtcgaactcacgcgccactacgggctgtcgcaatcggccatcggcctgttcgcgctggtcggggcgatcggcgcgacgtcggccccggtcgccggccgcctcgccgatgccggccacggcgtgcgggcgacgctgatcgcgctggtcgccggcgcgctgtcgtacgcggtcgcgctgatccatggcgccggcctgtatggcctcgtcgtcaccggcatcgtgctcgacttcgcggtgcagatgaacatggtgctcggccagcgcgagatctatgcgctgcacgcggcaagccgcaaccggctgaacgcgctgtacatgacgagcatcttcgtcggcggcgcgatcggctccgcgctcgcgagcccgctgtacgaacacggcggctggccgctcgtggccgcggtggccggcgcgttcccggtcgtcgcgctcgcccactacctcgcgatcgggcgtccgcacgcacgacgccacgcccagtcctgaaccggcgccggcaccggttcacgcgcggcgccctccgggccgctcgcgccggaacgctgccggcacgttacccccgtctttcttttccgaactttccgcagggcccgccgccagaccggtcgccaccacgcgacacgcggcgccgccctgcctcacgcaaaaggaatccatcatgtcttccctgctcagccactacgacctgcgcggcctgccgcttcccaaccgtgtcgtgatggggccgatgacgcgctcgcgcgcgccgtcgcgcggccagccgaccgaactgatggccgagtactacgcgcagcgcgcgtccgccggcctgatcgtcaccgaggcgaccaacgtcagcccggcgtccgcctcgttcgaactgacgccggggctcgtcaccgacgagcaggcggccggctggaagcaggtcaccgacgccgtgcatgcgaacggcggccggatcttcgcgcagttgtggcatggcggccgcgtgagctcgctgacgctgctcggcggcgacgcgccgctgtcgccgtccggcgtcaacgacgatctcgagcagttgcaggtgtgggcgcagttgcagaacggctattacacgaagattcacgcgacgccgtcgcgcgcgatgacgacggacgaggtggccgacacggtcgacgaattccgcgacgcggccgtacgcgcgatggcggccggcttcgacggcgtcgagatccacgcggccaacggctacctgccgcaccagttcctgtcgtcgacgctgaaccgccgcgacgaccgatacggcggctcggtcgcgaaccgcgcgcgcttcctcgaggagatcgtcgacgccgtcggcgccgtgatgccgctcggccgcgtgggcgtgcgcatctcgccgtacgcgaaatacaacaacgtgcgtgacgcggatccggatacgacgtacgcgtacgtcggccgcatgctcgacgaagccggcgtcgcctatgtgcacgcggcggacaccaacggctggagcggcgagcccgacctgccgcgcatcgtcgcgaacacgcgcaagcatttcggcggcacgctgatcgtcaacggcggcatcgcgccggatgccgcgaatgcgctgatcgacgcgggcgacgccgatctcgtcgcgttcgcgcgggcgtacatcgcgaaccccgatctggtcgaacgcctcgcggcaaacgcaccgctcgccgcgccgaaggcggtcggctggtacggcggcgaccgcgcgggctacgtcgactatgcgcgtcacgacgcggcgggcgtgagtgcgtaagcgcccgggtgcgcaggcgcgcgagcgcctgtgccccggctcacgccgccggagccagccggaacccgcaggacgccgtcaggcgtcctgccagcgtgcgccgagcacgcgcccgcagaaattcagccggtggaaatccggatcggcgcgttcgagcacgtcggcgctccacgtgccgaacgtcgacgccggccggtgcgcgacgccgcgcgcgaccgcatcgaggaacgcgtcgccgaagccttcgccgcgcgggtaggcggcgagcagcgcgcgccgctcgtcggccgaatacgcgtcgaaatcggtggccatcaggtcggtcgagacggcggccgccagcacgcgcgcgagcggcgacacgcgcgcggccacgccgggcgtcgtatgcagcgcgatcgcgtgccacacgtcgtcgcgcaggcgctgcgacgtctggtggcgcagcaggaacgtatcggcggcatcggcgctgtcgagctcgtagcgcgcggccgagcggccatacgcggtgctcagtcccatgttcgcgtacatcgcggccacgtacagcgcatcggcatcgcaggtctcgccggcacgctgcgcggccagcgacgcaagcacgaacacccggctcgcatgcccggtgatcgcccgcggcagcgacgcgcgggctgcttcggccgcttcgatcgccatcggcgtccgcggaatgcggacaccggcgacttcgtcatcggccgacgcgcacgtgtgcgcagaactcatctcgtctccttctgcccctcgccggggcgaaaattgtccatgcctcgcgcggcccgcgccgacgcagccggcgcgggcacgccggcggccggtacggcgtcggcctagtacgcgaaaccggggtaacccgatgcttcgcactgctcggcggtttccatcgcggccgcatgcaggcgctgcacgaacgcgcgcccgagcccgcgcgcggcaccggccgccggcaggcccgcgccggacgcggcgcgcagcgaagccgactcggccgaacgacgccggcccgcaccgccgaattcggcgaccggcgaccacgcggggctgaccaccggcggcggcggtgcgagcgacgcgaactcgtcgtccgcatgcacgatcctgccgccgacgaccgtcagcaccgacgacagcgacgtgatccgcgcttcgtcgatcgtgaagtagtcgtccgtcagcaccgcgaaatcggcgtagtggccgggcaccagtgcgcccttgcagtcgtcctcgccggaaaaccacgcgctgccgaccgtatagcagcgcagcgcctccatccggccgagccggttgcgctccggatacagcgccgtgccgccgaccgtgcgccccgacaccatccagtacagcgacacgaacgggttgtagctcgcgatgcgcgttgcgtcggtacccgcgccgaccggcagcccggccgccagcatcgcgctgatcggcggcgtgcgcgtcgcggcttgcgcgccgtaacgcgcgatgaagtactcgccctggaacgccatccggtgctggaccgtcacgccgccgccgagcgcggcgatgcgcgcgatgtttgcatccgtgatcgtctcgcagtgatcgaagaaccagcgcaggccgtcgaacggcgtctcacggttcacggcttcgagcacgttcaggaagcggccgatcgattcgtcgtaggtcgcatgcagccggaacggccagcggtgccgcaccagcagccgcaccaccgcggccagttcggcctccagcgccgccggcagatcggggcgcggttcgagaaaattgccgaaatcggcggccgaatacaccagcagctcgccggcgccgttcatccgcaggaacgcgtcgccgtcgccgggtttcgcgagcgtcacccagcgcgcgtagtcgtcgagctcccgccccgcatgctgcacgaacaggctgtacgcgacgcgcacggtcatttcgccgcgccgcgcgagtgccaggatcgcgccgtagtcgtccggaaaggcctggaaatcgccgcccgcgtcgatcgcgctcgtcaccccgagccggttcagctcgcgcatgaaatgccgcatcgaattcatctggtcgtcgtggccgagcttcggggcccgttcgagcgcctcgtgcagcacggccatgtccgggcgcgcgatcagcaggccggtcggccggccgaggcgatcgcgctggatctcgccgccgggcgggttcgacgtgtcgcggccgtagccgatcgcgcgcagcgcggccgcgttcagcagcgcgctgtcgcccaggtgcatgatgaagaccggcgtgtcgggcgcgatctcgttcagttcggccgccgtcggcccgcgctttcggcgaactggaattcggtccagccgccgaccacgcgcacccagtgcggcgcaggcgtgcgcagcacctggcgacgcagcatcgcgagcgcatcggccagcgtcggcacgccgtcccagcgcagttccaggttgaagttcaggccgccgcggatcatgtgcaggtgcgaatcgttcagccccgggatcacggtgcggccgttcaggtcgatgcactgcgtgccggcatgcgcatggcgcatcacgtcgtgcccgctgccggccgcgaggatccggccgtccttcacggcgagcgcggtcacgaacgactgccggtcgtcctgcgtcgcgatcttgccgttgcatacgatgaggtccgccgccgcggcggatgccgtcgccctaagcaccgtcatgccctccgcttgcgccgtgagccggcacgcggccgcatgccgcctgcctccggttcgacgatacacggaccatccactccccttgaacattgaacgatcggaccgacgggccgcggcgcgatggcgcggtgtcgtcctgcgcgaaccgggcatgccgttacgccacctgctgcatcgcatccgccgcctcgtgccgcatgcgcgaccggcccgccggcagtgccggctccgggcgcacgaagttctgcaggcgcgcgagccggcgcacgtcgaacgcgcgcgattgcggatcgaaatgccccgacaggttcgccaccagcgacgacgcctggccggtccgcccgcgctcgatcaggtgatcggcgagatcgagcgtgccgcgcagcgcccacatcgcggcgccttgcccgttcgcggtatggatcccggtcagcagatgccggtgcccttcgacttcgtacgcgagcgcggcatcgggctccgcggtgcgggcctgctcgagcatcgcgagcccccggacgcgcagcagttccggcacgaacaggtgctcgccgtgcgcgcggcagcgcgcgagcgtcgcgtcgagtttcgcgcatgcctcggccgcgcggccggtgcgcgtcagcccttccgcgtacgcgacgaccagcggcgcgagcaggcgccggaacccgctcgcctcgatgcgccgcagcgcgggttcgagccgcgcgagaccggcgccgggatgcccggcctgcatgtcgaactgcccggcgaggccttccgcgtggctgagccagatgtcgaacccgttcgcctccgcggtcgagcgcagcgtgccgagatagtcggaaatcacgtcgtgatcgccgtagcgcagcgcgatcggcacggccgcggcgccgagcacgacgcacagcgccagccccgacccggtgcggcgcgcggattcgaccgcctgcgcggccagccgcatcgcgtattccggatcgccctgcatccagacgagccgcatcagcatcgtgcggccgagcgtcgcgacgtcgaccccgagcgcggcttccgcgcaggacggctcgccggccacggccagcccggcggtcgcggcctccagccgctcgcgggcctgcgcgtgttcgccgaagtaatgcagcgacgtcgcgaccatcgcgttcgccagcagccgctgcggccggtcgccgcgccgttcggccgcgcgctcgaagcgcgtcgcgtagcgcagcgattcgtggatgtcggagcgcgtcagcatcgtgttccacagcccgaccagcgcgcacgcgtcgaacgcctcgtcgccgatccggcccgcgagcacgagcgtccggtcccacatcgcggccgccgcgtgcgtatcgccgtcggtatgcagcagcgccgtcgcgtaggctgcgcgcaggcgcagctcgcgtgccgcgtcgatgccgccggtatcgccggttccagcggcctcgatcgcgtcgagcgcccgccgcgccggatgcgcgcattcgcgcatccgcgccggttccagcaacgcgagcgccagtgcgtccgcttcgtgccctcgcggctcgaccgcgacgggctcacgcggcgccggcgccggtgcgtccgcggcgacacgcgggctcgcgagatccgcggccggcgccggcgcctgcatccgcgcctccctgctcgcgctcgtagcacgcatgacgctcggcgacgaggtcgaattcgccttcgttgcgcagtttctcgagcgcatacgcgcgcgtcgattccgttaaccggtaacgcgcgtgcgcgccgtggaactcgacggtcaccagcgacttcgcgaccagttcgccaagcaccgcgatcgtctcggcggccgacatcccgggatccatcgcgacctcgcgcgcggcatcgaacgtgaacgggccggtgaagcacgccatccggcgaaacagcgagcgcgcggccgcatccagcagcacgtagctccagtcgaacgtcgcccgcaacgtctggtggcgcggcagcgccgatcgcagcccgccggtcagcaggttcagccggtcgtccagacgcgcggcgacggcctcgagcccgagcgtcgcgacgcgcgcggcagccagctcgatcgcgagcggcagcccgtccaggcgccggcagatgtcgccgatcagccggatgccggccgcatcgaccgcgcagtcgggcgtggcggcgcggatccgcgcgaggaacagctcgacggccgaatgacgcacgatctcgtcgagcggcgcgtcgctgtccggcaccgccagcgggctcacgcgaaacacggcttcggccgagatatgcaggggttcgcggctcgtcgcgagcacgcgcagcgacggcgcgcgcgacgtcagcgtatcgacgagatcggccaccagatcgacgacgtgttccgcgttgtcgagcacgatcagggccggcgacgcggcgaacgctccggcgatccggtcgatgcccggcacgccgtcggtctcgaggccgagttccgcggcgatcgcgagcagcacgtcgtcgcgcgtcgcggcgctcgcgagcgcgacgaacagcacccgttcgccggaccgctcgcgcagctcgtgggcgacgcggccggccaggctcgtcttgccgatgccgcccgccccgacgagcgtgacgaccggtgcgcgttcgatcatgtcgacgatctgcccgatctcagcctgacgcccgacgagcgaaaccgggcgggccgccgcgacgggatcggccggcaacgcggccgcgcgcggcgcggcctcgtgcgcgacggcgggaggcgcgatcagcaggtagccgcggcccggcaccgtcttgatcaggtcgcggtccgcgcccagcgccttgcgcagcgtcgcgatgtgaacctgcaaccggttttcctcgacgatcaggcccggccacacggcatccatgatgtcgtccttcgacacgacggaaccgttggcgcgatgcagcacttcaagtatgtcaagcgcgcgtgcgccgatacgcagcgacgcgccgtggtggcgaatgtcacgctgctcgaaatccaccgacaacgtcccgatctggatcatggccgcctccaggttccccacgatgaccgccatgtgaacacggccgttcaccagggcgggaatgcacacccgtccagcgctgccggccgggcgcaaagtctcaaaatgtggactgagtgtaaacaccgaattaacaaaaatcttgaaggaaaatgcgctggcctcccgcacaccggcgcgcccgcgggcgggcgccgcgccgaatgaaaatggggtgacatcggccccgcgttggccatggcggcgcgctcgcgtgcccgtcgaggccggcgcggtgcgggtcgggccgctggcaagcatttcgtcagcaagtggacatttattcaagttaacttgggccggtcgagtgcaccgtttaaacttcgcgtaaatatgttcgcgcgccgcccccatcgaaggattgttccgccatgccagattccctcgtcgcgtccccggccgcacggccgaaagacacgctcggctgcctgtcgagcctgctgtccaaggacatcgaacgcccggtcggcgggctcacgctccaccgcaaatgcatgcgcgacgagcacttcgagcgcatcgagatggcggccagcgatcgcggcttcctgatcggcgtgtcgctcaacggcgggcaccggcgcacgatctacggcggcaccggccaatcccgctccgagcggcggttccagcacaactcgatctacattcgcgacttctcccggaattttcgtgccgacctgtacggcaagttcgacttcctgctggtcgagctgtcgcacgcgtatctcgacggcctcggccgcgagcacgacggcaccgaaatcggcggcctgacctgcgcgcccgacgtacaggacgaagtgctgggccatctcgcgcacgcggtggccgacagcctcgacgagcccggcgtgctgaacgcgctgttcgtcgagcagatggggctcgcgatcggcgcgcatctcgcgcgccagtacggcaacgcggacgcgcgcgacctgcagcacaagggcctgctgtcgccggcgaagacggcgctcgcgaaagagctgctgatggagaaggccgatctcggcgtgtcgatcgaggaagtcgcgcgcgagtgcgatctgtcgcgcggctatttcatccgtgcgttctcgcgcacgacgggcgcacgccgcatcaatggctgctcgaacagcgcgtgatccgcgcgcggcaactgatcgagacgaccgacatgtcgctcgcggaaatcgcggccgcctgcggcttcgcggaccagagccacctgaaccgcgtgttcgcgcgcatcgtcggccatccgcccggcgcctggcggcgcgaactgacgcgctgacgctgacgcggccgcgcgccaccgctacgcgcgcgccccgcccctcactgcacgacacggcacggcacggcgcgcatcgcccgtcgctcaccggagcggcgtcgcgtcgtaattgaccggcacccagtcgtactgctccccgtccctgcgcaaatgcccgagcccgggaaacgcgatgtgcgcggcgccgacgaggtaacgcttgtccgcgacacgcttcagcgtatcgcgccgggtacggcgcgccgcgtccgcatcgctgtcgtactggaccgtcgcgtccgggtcctgcagctggatcgccgcgacgtgcacgatgtcgccccacgcgagcagcccggcgtcgccgctctcgatcaggtacgcggtatggcccggcgtatggcctggcatcggcaccgcgcgaatgccgggcgcgagcgtcgcttcgccgcgaaacgtcctgaagcggcccgccgcgacgtacggcgcgaccgacgcggcagccgcatcgaagaacgacgcgaggaacgccggcgcctgtgccttgttgtccggatcgagccagtagttcgcttcgatctcgttcacgcgcaccaccgcgttctggaaggtcatcctgccgttcgtcacgatgccgccgacatgatccttgtgcaggtgcgtgagcagcacctcgtcgatctgctccggcgcataaccggccgcacgcaggttcgcgagcagcttgccgcagcaatcgccgtacagcacgccggccccggaatcgacgaggatccgcttcgtgccggtatcgacgaggaacgcattgatcgagccctgcacgggcggctcgagaaacgcgcggtcgagatcgcgccggatgtcgtccttcgagatgccgcggaacaccgtatcgaccggaaacggatgcgtgccgtcggacagcgcgacgatccgcaagctgccgagctgctgccgatagaagccgggcgcctgatccgcgccgcccggttcggcggcacacgcggccgatgcgaggatgccgaagcaccacgcgatgaccagcatgccgccggtacgccagttcaggttcttcatgtccgctccccggttgcgtatcgagatatcgcgcgcgttgccggcccggccggtcaggcgcgcgacaccgagcttaccggccggtttcgcaataatcctgagcgcaacatgaatcgttctgaaagccggcacccgtcggcgccggcccggcttacacggcccgatcccgcgcgcgctgcgcgtcgagcaatgcggcgcgaaacacttcggccggctgcgcgccgctgacgaccgtcgacccgatgcgcgtcgacggcaccgacgcgatgccgtcgcgcaccgccgcctcctcgagcgcgaccaccgcgtcgagcccttcgccggacgcgaggaatgcacgcaccgcatcgccggccaggccggcgccggccgcgatctcgaccagcacgtccgcatcgccgatatcgcggccgtcgcggaaatacgcggcaaacagcgcatcgacgagcgcgaccgcgttgccgcgctgctgcgcgaaccagacgagccggtgcgcgagccgcgtgttcggcgtgcgcgcgatccgtgcgtggtcgaacacgaggcccgccgcgcggccggcgtcggccacatgcgcatcgagcgcctgcgaacgcgcccagctgccgaacttcgcgctccggtatgccttgcggtcgatgccgccggccggcatcgtcgggttcagttcgaacggcacgaaccgcacggtcacggcgccggccaggccggctgcttcgatcgcctccgcgagccggtgctccgcgatccagcaccacgggcagatcaggtcgtaggtcacggttacttcgacgggtttcatcgtcatctcctgtacattgcagtccggaagataacgcttgcgcggcgacgatagaatgcgaacggcacgcaacgcatcgttgcggcctgcacaaaggcacaaagactcgaagagcacgacatggacaaattctccgcgctgcgcgcgttcgtcgaagtagcggaagccggcggcttctcgagcgcggggcgccgcctcgacctcgcggcatcgtcggtggtacgcgcggtggatgcgctagaggcgtcgctcggcaccgtactgctgaaccgcacgacgcgccaggtcacgctgtccgacgcgggtgccatgtactacgcgcgcgcgaagcagctgctcgaggaactcgcggaagccgacgcgctggtgtccgatcgcggcgacgagccgtccgggccgctgcgcgtgtcggtgccggtcgcgtacggcgtgcgccgcatcgcgccgcacgtcgcggcgttcctcgcgcgccatccgaagctcgacctcgacctgcagctcaccgacgaacgcgtcgatctcgtcgcgggccgcatcgacgtcgcgatccggctcggagaagcggcgccgtccgccgaagtcgtcgcgcggacgctcggcacgtttcaccgctacgtcgtcgcgagccacgactatctcgccgcgcacggcacgccggccgagccgggcgagctcgtcgatcacgcgtgcctgcgctttcacttcggcggcgaccagcaggcgtggtcgttcgtcgacgcgcacggcacggcgcaggtgcgcgtcaccgggcgcctgaaatcgaaccacagcgaagtgcttcgcgatgcggtgctcgacggcgccggcatcgcgctgctgcccgactggctggtcgaggccgacgtccagtcgggccgcctgcgccggctcttcgagcaatacgacgtgacgcccggcacggcccgctcggtcgtcaccgcgctctatctgccgacgcagcgcggctcgaaacgcgtgaccgcgttcatcgatttcgtcgaaacgctggtgcgcgcgccgcactgagccgtccggcggcgtgccgcgcggcgcagcgctaccagccgaacttcgcttcgacgcctacgtagtcggcattgcgcgcgccgagcgcgcggatcgagtcggcgatctggaagtgcacggcctcgacggccagcgccatgttcggattgacgagccagtccacgcgggcctgcgcatacatccccgtgtacgagccgcccttgccggccgtgccgggcaccgccgacatccctgcccgtagatcgcgtcggccgtcgtttcgcgccactggaaaccgaccgcggtcagcaccgtcacgctgctcgacggcttgaacgtcagcgacggcttcacgtgaatcaggttgctgtagccggtgtagcccgcgagcgtgaagtaatagccgttcgggaacagcgggttgaaggtgcccatgcgaccgtcgccgggatgcttgtcgcccgatgcgccgtcgacctggatgccgacgcgcggcgtgcccggcgtcttcgcgaacgtgtagccgcccagcgcgccgaatgcccacgcgccgatcgtgtcctggccgatgtgcccggtctggagcatcgcctcgacgtcccagtcgaacccgctggacttgcccgcgtagcgcatgtcgaacacgtcgcgccgctcggtgccggcccccgcgatgtagcgcgcattgtcgcgcgtataacgcgaccagtacgccgacaggtcgccggggcccgtgttggtgcgttcgacgcgcacgccgtcgaaccgcaggtgccggttcgacacgtcgtcgaacgccgcgtcgttgcgatactgcaccgggcgcgtcacatagccgatcagccgccacttgccgatttcgtaatccgcccacagcgcgtcgaacgcctggcgcacgttcgggccgtcgcgcaccgacacgaaccgttgcaggtcatacgccatctcctgccggccgatccgcgccttgaacgtgccgccgccgatctggtcgacatacgcgacgaacgcctgctcgatgtcgagctgatccttgtcgacgggcgacaccgtgtccttgccgaacggccgcgcatcgacgaactggacgaacgcctggaaatgcccggcgtaacgcagatccgcatgcaccgtcgcacgctggatcacgtagttgtcgtcgtgcgcggcgccgagcccgaacagcggcgcgttgttcagctcgaagcgctcgcgcaggttcgcgccgagcgacaggtaggtcgacgggtcgccaccgagcgggatgtacttcagcgcatcgcccggctggcgcggcacgcacgggttcgcgagcaccgaccagtcttcctgccagcggttgaacagcaccgtgggccgcttcgcggtacacgtcgtgccagcagccggggccggcgaagctgtcgaagccgccgaagcggcatcctcggccccggccgccgtacccgcatagcccgcgacgccgcccgccagcacggcggccggcagcacgcggcgccaggcgcgccccatcgacccgcgctccatcacttcgaccgcgtgtggatctcggcgacgtagccgcccgggaactgcacgagcgccgcatcgcgcccgtccgacgtgaacgtcggcaccagcacggtcacgcccgcggcctgcgcctgcttcagcgtcgcggccaggtccggcacttcatagccggtcatctcgcggccgaacgggtaaggcagatggccgtcggtggcgagcacggtcatcttgccgaaacccgattcgatgcggatgcggcgatacgtatcgttcggccggccgatctcgatgcccggcgccttgcgcacgtcggacaccaccttgccgcgcgagaacgcgacgaagtcgtgcaccagcttgctcgcgctttccggcgacacgtacacgcggttttccggcaccgtctgcagcgggtcgtatttcggcgcttgcgtgtgccagtagagctgcatgttcacgccgcccggccagcggatgatcgcgtcgcggccgatcgggtcggggaacgtgtcgacgaccacgtccgcgccgtgcgcgcgcgccgatttcatcgcgacgtccatgtcggtgacgaggtagccggtgcgctcctcgcagaacggataggggatcggcgtcttgaagccgaacaccgagatcgtgccggccggcgtgaacacgagctgcgacatcgtctggctcggcgtcggcgtgacctggaacacgccctgcttcgacttgctgccgccgaacgtcgcgacgaagctgtcggtgaagcggtcgaaatcttccggcgcgacgcacacgtgcgtcgtgtcgtactgcgggccgaccgcgacggccggcaccttcgcggacgtcgtctcgagcaggcgcgtctcgtcggcatgggccggcgcggtggccagcaatgcgccgagcacggccgccgacgcggccgtcagccgccatgcctgttgcaatttcagtgcgatcatcgggttctccttgaaagtggcgcgcgcggccacatgccgcgcgcgcattcagcgtgacgtcggccgctcgtcgggccgaccggattgataggcgaggaagcacagcaccgcgagcggcagcgcgagcgcccagaacgccgcgaacagataggccatcgcacccgcgccggcgccgagcgcgaagcccgcgaccggcggcagcgtgcgccgcagccgcacgcgcgcggcttcgcgttcggccggcgcggcgagcggcaccagccagtcgaatgcatcgatcaccgcctgcgtgacgttgcccgtcatcaccgtgttggcgacgaccgagcgggccgtcaaccgcgcgtgcgcgttctggacgcccatcgccgcggcgccgaggagaccgcacaggatcgtcctcggcgcgtcggcatcggcgatcggcgaggccatcacgccggccagcatgaagccggccagcagcacggcctgcagcgcatacagcgaacgcgcacgcacgccgtggcccagctggcgcatccggtggtcgagcacgcgcgcgacgacgatgcccgcgatgaaggacggaaacgcgagccacttgatcgcgagcccttgcccgacgccggccaggcccgagccgatcaggatgaagttgccggtgacgtgcgcggtgaacaggccgaacagcgcgacgaagccgagcgtgtcgacatatcccgcgatcgacgcgagaaacacgtcctcgccgcgcacgcggtcgggcacggcgcccgcggttaccggctgcgacggcatgacccggtttcctggatggtggcgccggcgcccggcgagatctgataacgcatgttccgctccggttgcgccgaccggcccggcttgccgactggcatccggcccgtgcggcggttcggaagccagactagtgaaggccgaccttaatgtcatggcggccgcctgaattttctgaatcggcggcgggctcgcgtggccgaggggccgggccggcacgacgcggtttgcgccccgcaccggccccgcagcgcgccgaaagccccgccgcgcgcggcatgcggcccgtcaatcgtgctatttttcgatcgatagttaacgcaggcgcaccatcgggagccgatgcatgaccgaaagaaaacgcagcacgccggcccgcgagcgcgggacggacgccgacggcaacgccgtcacgccgggccgccggctcgcgccggaagcgcgcgagcggcagatcgtcgagaaagcgatcgagcacttcgcgacgcacggcttttccggcagcacccgcgagctcgcgcggcagatcggcgtcacccagccgctgctgtaccggtacttcccgagcaaggaagcgctgatcgaccgcgtgtacgacgagatctacacgtggaaccccgactgggaaaaactgatcggcgaccgcacggtgtcgctgcaggagcggctcgtcgcgttttatcgcgactatgcgcaaaccatcctgcggcgcgaatggatccgcacgttcatcttcgcggggctcagccgcgagggttcaacacgcgttacctgtcgcggctgcgcgaacgcgtgttcctgccggtgctgcgcgagctgcggcacgaatacgacatcgcgacgcccaccaccgaggcccagcgcaatgcggaagtcgagctggtctggagcctgcacgcgagcatcttctatttcggcgtgcgcaagtgggtctacggcctgcccgtgcccgacgatctcgacaccgagatcgaacggctgatcgacgcgttcctgcacggcacgcccgccgcgctgaagcagctcacgtcggacgcacccgcgcggcggcgccggcgcggctgacacgggtggcgggcatgccgtgcgacgacggtcgcatcgtcgtccggcatgttcacgcttgtgcgtcttcgtcaggcccgcacgcgacgggacgccaccggccgagcgaatcaaatggggatcgggaaccgcctgccacggccggcccgtgaccaggcaagccggttccggccgtgcgcgcaatcacgcgaattcagaacaatttatccggcgcgccacacgattcgcctattctcgaaaggcatttgcggccgcgccggtttcgcgcgggccgaaccgaacagcgaccgacccatgaccctctccatgccctcgatcacccatcacaccgtcaccgcgaacggcatccgccagcactacatcgacgccggcagcgggcccgctgtcgtgctgctgcacggcttcccgagaccagcttcgcgtggcgcttccagattcccgcgctcgcgcagcgctaccgcgtgattgcgcccgacctgcgcggttacggcgaaaccgacaagccggccgccggttacgacaagcgcaacatggcgcgcgacgtcgccgggctgctcgacgcgctcggcatcggccgcatcgcgctcgtcgggcacgaccgcggcgcgcgcgtcgcgacgcgtttcgcgaaggacttccccgagcgcgtcgaccggctcgtcgtgatggacaacgtcccgacgcgcatcgtcgcgcagaacatgaccgcgcaaacggcgcgcgcgtactggttcttcctgttccaccaggtgccggatctgcccgaggcgctgatcgccggcaaggaagccgagtggctcagccatttcttctccgactggtgctacaacccgcacgcgatctccggcgacgcgttcgacacctacgtgcgcgcgtaccggcgcccgggcgccgtgcgcggcgcgctggccgactatcgcgcgaacgccgaggacgtgcagcaggatctcgtcgacgcggacgtcaagatcgcgtgcccgacgatggcgctctggggcgaggatttctacgcggtcggcaagatgttcgacatgaaatccgtgtgggaaagcatggcgacggacctgcgcgccgagccgatcgcacagtgcgggcacctgccgcaagaggagcagccggagcgcgtgaacgcgctgctgctcgacttcctgcagcactgggaaggctgattcgatgcgcgcgcaacgaaccatcgggaggcaggcagcatgagcgacgtttcgggcccgctggcggtcgtgatcggcggatcggtgggcgggctgttcaccgccacttcactgcgggcggccggctggcgcgtcaaggtcttcgagcaatcgccgaacgagctcgacagccgcggcggcggcatcgtgctgcaaacgccgatcgaacgcgcgttcgcgttcggcggcgtgcccgtgccgcacgatgcgggtgtcgattcgggcgaccggatctatctcgacgcgcacgaccggatcgtgcaacgcatgaacatgccgcagacgcagaccgcgtggaacgtgatctacacggcgctgaagcgcgcgctgcccgccggcgtcgtgcatggcggcgtgtcgttcgagcgcttcgagcaggagggcgaccgcgtgatcgcacacttcgcggacggccgcgtcgagccggccgacctgctggtcggcgccgacggcggccgctcgaacgtgcgggcgcaactgctgcccgatgcgcggcccgcgtatgcgggttatgtcgcgtggcgcgggctcgtcgacgagcacctgctaccggccccggtgctcgacgtgttgcgcgaccgcttcactttccagcaaggcgacgcgcacctgttcctcacctatctggttcccggccgcgacggcgcgatcgagccgggcaagcggcgcgtgaactgggtctggtaccggcggctcgcaccggcgagcctgccgtcgctgtttctcgcgcgggacggcacgcagcgcgacggttcgctgccgcccggcgcgatgcgcgacgacaaccggctcgaactcgtggacgcgggccgccggatgctggcgcccacgctcgccgcgctcgtcgacgcgacgcaggcgccgttcgcgcaggcgatcctcgatctctcggtcgagcgcatggcgttcggccgtgcggtgctgctcggcgacgcggcctgcctcgtgcggccgcatacggccgcgggcgtcgcgaaagcggcggagaatgcggtcgggctcgccgaagcgctgcgcggcgtcgtgcacggccccgcgttcgacgccgctctggcgggctgggaaagccgtcagctcgcgaccaacgcatcgttgtccgacctcggcatctcgctcggcacgcggatcatggggcgcgcgtgaccgtccggcggtgcgcaccgctccggtcgatcgagcgtgcgggccgggccgtcacgcgtggcgcacgacgatatcccacgcggtatgacacgcctgccccggcagcgtcagcgcgcgcagcaccacccgatcgccctgctgcgtcgcgacgctgaacttatgcggcgccagcagcgcgaccgtcgcgccgttgtgctccagttgcaagcccggcgccgcaggctggccgctcagatgcgacagccagatgtccagcaccaaccggtcgcgcgtcaccgcgaattcgaccgtgtgcgccgcccacgcattcagtgcatggccctgcgggttgcggaacgacggccccgcggccagacgcggtacgttcgccagcacgtcctcgtgcgcggccagcaccgacaacccgctcgcgacgaagcgttcgggctgaagcaggccgggatcggccggctgcgcccgcttgccggcttcgggcgccagcgcgaacgcctgcccgagcgcgatcgcatgctcggcatgacgcgccaggtagcgccagtgattcaggaagcgcacgtcgcccgtcatgtgcaggccacggatcggtttgccctgatgctcgagcacgatgcggaccgcgtcgaaatcgtgccgctcgtgcagccccatttcgtgacgaaattctgctcgcagcccacgagccgcacgtggccgcggccgccccagatgcaggaaggtcgtgtccagcccgtagatcgccgcgaagtcccggccgatcctgccggcctgttcgcggacaaaccgcgcgaatcgcgcccagggctcgcggccgccgaccacgagccccgcctgtagcggctgccccagccgctcgagcacgtcctgaacgcactggtggatcagcgcgtcgcgccgttcgccgatgagcggcgtcatcacgaacgcgcagaagtgcgcatcgggcgcgacgtaaagggcgtcgtcgtgcggcacgatgtcgaagatgtcgaaccgcggccccgggaaccagatgtcggcatcgtagagcgcgagcgtctgcaacgccgggtcggtgtcgaagatcgcggccgcggagatgtagcggtcccaggcaaggtcgccgacgcccgccgccgcgtacacctcgatcccgttcgcgcgcagccgctgctgcttctcgtcggacaacccgtagccgatgacgccgatgcgccccggtagtccgtcgcgcgcagcgagacgatgaacgggatgaccatttcgtaccaggcctgcgtgttgtcgtcgatcgcgaacgcgacgagttgatggcggtcggtctcgttgttgtcggacgtgttcatgcgtgtggtgagattggtcagtccgtcgttccgatcggtccggctgccggtgttcctttacacgcgacgccgattatcggaaggcagtcgaatacccgttatcgtcatacgattgcgagcgatatccattcggcggcggcccgttcgccggggccgttcgccagaaaatggatgcacgatttttaccacggcgcgatattcccgcgcgacctgaaaatgcgtcgcgattccgaacatttgttaaatagcttgaatgaccgacaaccggccggcaatttgccttaacatccggccgtcatctcgactgacgccgatcacggttgaccgaccctggactccggccgtggctttcatttttcaggtgcccgaacgcggtgccgatttcatccggacgctacgaccgatcatgttccagaccccgggagattcattcgtcaacggctcgttgctgggcctgtgcgtcgaggtgccgctcgccgcgctggtgtcgctcgccatgcacggcgtcgactggaacgggcagcgcatcgcgatgctgatcgccacgccggtgctgctcgcctgcattgcgctgctgacccgcccggtcgcattcagcacggtgtggaagcacaagcgctcgccgttcgtgctcgacgacaacgtgcgtgcgtcgatctacggccggctctgcgggatcgcgctcgggctcgtgttcggcatcatggtcgcaacgacgttcgcctgatccggctgaaccggcgcgcccgacgaaacctgcgtcgggcctgaagccgccgggtcacgagcgcgtcttcccggcgcatcgcgtcacgccgacgccaccagcgtgttgaacgacgtatcccacagcggcgcgacattcgccggcccatccagcacgccgatccgcgcgaacacatccgcgacctgctgatgctgcgccaccacgtcgggcgtcaccggcagcagcgcatagtcttcgctgcgctggtcgaacatcgcgacgagatcggccaccggcacgcgcgtctcctggttctgcacccgcgcgtagtcgccgaaatgcccgttcgcccacgcgtacgcgcgccggaaccgcagcagcagatcgcccgtcgccgcacgacggcgcgcatcgtcgagcgtgcgcgggttcgcgtacaccgggaaattgcccgacagataacccttccccgtcttcagcacgcgcgccccgtagcgattgcgcgcgagctggccgttgtagccgtagatcgcccatgcgtcgatgtcgccgcgatcgtaggccgacaacccgtcggtcggcgacaggttgatcggctggatgtcgtcgaagcccaggccagcttccgtaagctggcgatacaggaagtagtgcgacgtcgtcgcgcgcacgtagccgacgcgcttgcccttcaggtccgcgatgctgcggatcggcgtgtccttgcgtgcgagcgtgacctggttgttcaggtcttcgcgcacgcgggtgatgagccggacgctggccttctggcgcgcggcgaacacggccggaatttcgctgcccgaaccgatatcgagcgcatctgcattgagcgcctcgatgtgcagcacgccgttgttcagttcgcgccagtcgatccggtacggtgtgtcgccgaggccggccgcctgcagcagcgcgcgccagccgcccttgtaggtcgcgacgcgcaacgtcgtgccggcgagatcggtgttgacggccggcgtggcgaacgcggccttcccggcgaacggcgccgccacggccgcggcgccggcaagaatcaggcggcggcgcgccgccgacgttgacgccatcgaatcctcctgtcgatcggttgcgaattgagcggaagcccgcacagctgcatcaatgcagcaccgggaacccgtggcgctcggccagcagttcgaggatacggcgcgcgtcggtgacgaaccgcacgtcgccgagtgtctgcgcgtcgtccggcgccggctggtcgcgaccgagcacgaggaccggcaagccctggtgcgcatcgtcgagcgcctcgatcaccgcgtggcgcggccgctcgaagccgacgcgcttcacgtcgatgcggccggcatgctcgggcgcgctcgccagcagccctcgatcgacagtccgtgcggacagacgaaacgctggcccggatgcttcgggtcggcaaagcccggttccagcaaaaacagtacatcgcgactcatgtcaaacggctcccgtgttcgttgttcagccgggacgcatgcgcacgtcggcgcaatcatggtcccggagcaggccggcccgcggccggatgcccgactctaccgttgcgcgtcgcaccgccctaccaacgttttgagaaatcgatatgccggcgcgcatagcgcatcgatcgtgcgccgcacagacggccgttgcgtaaatgcatcgcccgttgcatcgccgacattgcggatatcgaaccatttcatcgatcgatatgacggaggccgcgggtagccggcgcccgacgttcgccgttcgagcgatgcgttcgccgcagcaggggtgccggacgcgatcgcgacgcacatgccggacttgcagcaatgcacattacaaatcggccgcgcagcgatttacaaaccacggatcgaccgttcgccggttcaacccgcgtcaatagcatcgtgctccttacagtcttactcataaaaacagaggaaagtcatgatcaaaaacggtagtcctgggtttggtttcgatcggttcggtcagcgcgcatgcgcagagttcggtcacgttgtacggcgtcgtcgatgccggtttcgcctatacgaacaaccagggcggcgcgagcaacatccagcagacgagcggcaagctgagcggcagccgctggggcctgaaaggcgtggaagatctcggtggcggcctgcaggcggtcttcacgctcgaaagcgggttccggccgagcgacggcgggctcggccagggcggccggctgttcggccgttccgcgtacgtcggcctggccaagtccggcatcggcacgctgaccttcggccgccagtacgagccgatcaccgatctcgtcgcgcagtactcggggtccggcttctggtcgccggccacgcacgtgggcgacaacgacaacatgaaccagagcttccgcctgaacaacgcggtgaagttccgcagcgacacgatcgccggcttcacggccgacctgctctatgcgttcagcaaccaggcgaacggcggcgccggcaccggcttctcgaacaacaatgcgtggggcgtgtcggcgaactacgtgaacgggccgctgtcggtcggcggcggttacgtgcgactcaatcacccgaatgcgacgtcgaatacgaccggcgcggtgggaggcgcgacctcgaccaccggcaacgactacagcggcgcgttcttctacgggctgaacggcggcgtgctcaagcagcagatcggcgtggcgggcgcgaactacgcgctcggccgcgcgacgctcggcttcgcgtggagccacacgcagctcaactatctcgacggctcgtcgcgcaagttcaacaactacgacgtgaacgcgcgttaccagatcacaccggcggctacgctgatcggcgtctatacgttcaccgacgggcgcgcgagcggcctgccgggcaccggcggccagacgctgaagccgcgctggcaccagttcacgctcgggttcgactatgcgctgtcgaagcgcaccgacatctacgtgtcgggcatctaccagctcgcggccggcgatgcgagcacggcgacggcgggcggttatcgcaggatcgcggcgatctcgaacatcggcagcgcgtcgtcgacgaaccgccaggtcgcgctcgtcagcgggctgcgcgtgaagttctgacggcatgcgcagcgggtgtggtgcaatgcggtgcggcgcgataagcaaagcgggaatcgttgtttgccgcgccgtgcccggttgccgagaatgtgcgtttcccgtgcgctgcccgcaggcgcgatacgcgttcgacgatgaccgactcccgccccgcatgccgcgcagcagccggcgtgcggcactgcgtcggcacgccggcgcatcgggcatcgcacccgggcgattcgccgccgcacgtacccgccgttgtcgtgcggtgcgtgcccaacccgcaaggaagccatcatgagcgcccctccgtcgccgctccggttgcgacgtcaccgttcgtcgacgtccgctcgccggcggatttccccgacagccccgtgtcgcgcgtgctcgcgcagccgctgatgctcgggctgttcctgccgatccaggccggcggctggagcgcgtcgacgctgccgcgcacgaccgactggacgttcgactacaacgccgagctggtcgcgcgcgcggaatcgctcggcttcgatctcgtgttcgcgctgtcgcaatggctgccgaaaggcggttacggcggcgtgttcgacggccacgcgctcgactcgttcatgacgctggccgcgctgaccgcgcgcaccgagcggatcatcctggtcgcgacgagccacgtgctgtacgggccgtggcacccgctgcatttcgcgaagttcaccgcgacgctcgatcacatctcgcgcgggcgctggggcatcaacgtcgtgactggtcatcgcgccatcgagcacgagatgttcggctggaaccggatcgagcacgaccggcgctacgagatggccgccgagttcgtcgacgcggtgcagcagttgtgggcgcaaccggacaatttcagctacacgcccgcgctgtcgggctggcggctgggcggcgcgttcgtcacgccgaaaccacgctacggccgcccgctgctgatcaacgcgaccggctccgacgcgggcatcgagttcgcggcgcgctattcggacatcgtgttcgtcacgagcccggccggccccgacgccgaacgcgcgatcgacgccctgcccgcgcataccgcgcgcgtgaaggcggccgccgccgcgcgcggccggacgatccgcacgctgctcaacctgctcgtgatctgccgcgaaacggcagccgaagcgcgcgcgtatcgcgacgcgatcgtcgcgcatgcggacgaaggcagcttccaccgtttcgacagcgacgcgcatgcgtggcgaggcggcttcgaacaacgcgcgcaggccgacgcgcgcgcgatcggcggcaatatctcgatcacgggttcgccggaggaagtggcggacaccatcgtgcggctgcaccgtgcgggcatcgacggcatccagttgagcttctacgatttcaagcccgatctcgacttcttcggcgagcgcgtgctgccgctgctgcgcgacgccggcttgcggcgctgacgcgggcggcggacgtgtcgcccgccgcggcactcaccgtttcgacacgacgtggtcagaacacacggccttcggtgaggtgcgtcgtcacgccgttcaggtcgtagtcgccgatcacgcgcgccttgtgcagcagcgggttgtggctgaagatcgtgcgcaggttgcgccagtgccggtcgaagttgtgttcgcgcgccgtcgccgatgccccgccgacttcgaacagccgctcggccgcgtgcagcgcgagcttgctgacgatgagctgcgtacgcgcggttgcgagcgcgctgtcgagcacgcgtgcatccgcatcggcatcgccggcctcgatcgcgtcggcggaacggtcgagcgcccgcgcgttttcgcgcacgagcgcgtcgatcgcgtgactgtgcgcggacagttcgccgacgacctgctggatgaagtgatcgtcgcgcgcggtcggcgccgggctgtgcagcaccgggcggccgtgcgcgagcacgtaacgacgcgcatcggcaaccacgttgcgcacgatgcccgcgcccgtcgcgacgagatgcagctggcgcagcgcgccgcaatgacggccgacgagcgtcgagccgtcgcgcggggccacttcgtccgcgaacacctgcacgtcgtcgagcagcaggctgccgctcgcggtcatgcgctggcccatgccgtcccagtcgtcgagcacccgcacgccgtcgcgcgcgacgggaatgatcacggcgaccgcgtcgccctgctcgttctccacgttgatgcgcgcgaaatcggcgaacgcggtgccggtcgaatagtatttgcgccccgtcacgcgatagtgctcgccgtcccggcgcagcacggtggtgttctcgcccggccgcgacgtgccgcgctcggtcgacgcaccgccgaagatcgcgccggccagtgcccgctcgagctgcacgtcgttgaacggcgtgcgcggcgacagccgcagcgtctcggtctggtcgtagtggatccgcagcgcgtgcgcgaggttcgaatcggcggcggccagcgtcgcgatcgtgtcgaacaggtcgaccagcgtgccgccgaggccgccgcgcgcgaccggaatccgcagcacgcccagcgccgagcgccggaagtgtgcgaaaccgtcgaacggcaattcgcgacgcgcctcgcgttgcgcggcatcctgcccgatcgcgctcgcgagatcgggcagtgcggcgagcgcgtcgcgcaacgcgtcgcgcggatcgacggcatcacgggcggtcattctgcggttccttgtacgagaggttcgggaatgccgctgcgcggtgcgatcgcgacatccgcgaaccggcgcacatacggcaccgcaaagtatagggacgccccggtgtgcgtgaaaagccgatttcagcttttgttatgcgtgtgccgggaatggtcgagcgacatcgcagcgtcgcgccattgcgcgataccccggcgcggcgcggtcgtgcgtggcgaccgtcacgattccgtcgacgggtcgggtacgcgcacgatgccctccggataccggatgtcgatcagcccgtgcttgtcgcggatgcggatcggcggcacgacctccacgctcgcacggtcgacgccctcgcacacggccaggttcgtattggtgcggtagtacacgcgctggtcgtcgaccgcaaaggcccagttcagaaagcgcaggcttcgtgcgtcgatccccggcagcggcttgcggtagttcttccccacagcacgtgaccgtcggcgtcgatcagcatgtcgtgaaagacgccgcgcgcggtctcgacgtcgacgcgccccggctttgtcacgatcttgccgtcgtaaaggatctgcgcgccgagccgcgcataccggtagccgaggctcaccacgccggccggatcgtcgatgccgcgcttgcgcacaccggcgcagaacaggtgcttcgcatcccgcgcgtacgcgccgccgatatgcgtcaggctggccacgtcggccttgacgacggtcaggcggcatgggccgcgatcgggatcgtggatgtcgcgctcgacgtggtaagcctgccgtgcatcgcgataccagccgccgcccaggggttccagcgtggcggcatcgccgtcggcaacgagcccttcgcctgcgtcgtcgtagctgaacgcggcgccgcccgcgtagtagcgcagccccgacgcatcgacggcaaagtggtcgatcaggtgccggaagctgcccagatcgaagttgttgagcgcgcgatactgatgcccgctgccggtgcgggcccagacgcgttcgccatcgctgtggaacggcccgccgagcggggcaagcggctcgttgcgcgtgtcgcgccgccgccgcgcttccgcctcctcacggcgctgtgcctcctcggcgtcgtagatggcctgctgctccggcgtgacccgcgccgcatcctcgtactgctgcatgtggcgcgcatgcagcgactgcacggtcgcgatgcagtacaccgaatgcggaaccgagcgcagatacagcgcccagtcctcgtcgtcgcaccggtagaaccagtggatcgcctcgccgtcccatccggccgggtcggtgcgcgcgagcagcgcggccttgacgtcccggaccttgccgggcacgacgaaggaaaggctgtagctggtgtcacggacgatgtcgaggctctcatcctcgaacaggcgtcgcatcagtttttcgagttcttgcaaggtcatgggcgcgtgtcgacccggtgacgggccacggaatgaacggacgtgcggcggtcattctaaccatgccgacgtgcgctgccccggcctccttcgggacattcggtcgatccatcgcgtaaccgcccggatacgaacacgtcgacgatcgtcatttcaccgcatccggttcccgatcgggaacgaaacgggcattccgttgccggcacgatcaattcgtttccgttcggatacgaattgatgcctgcgccaacgagttgtgcaatactgttcccgatcagatacgaagcacggaggacgtcatgcacgagatcctgcccgtcggcacgatcggcgcactcgccaaccttatccgcgcggcacggctccagcagggatttacgcgggacgaactcgcgaacgccacggggctttcgccgaaattcatcagccaggtggaggccgggaaacccaccgcgcaggtcggcaagattctgctgctgctcggcgaactgggcatcaccctgctcgcgcaatcgtccatcgagatttcggcggcaaacgtgctgaaggccgcgcaacgccgcaggagccgccatggcgagtagaacgctgatcgcctccgcgaacgggttgcgcatgggcgcgctgaccgacgacaaaggcgtctggtcgttcacgtacgacgcacagtggctggcatcgccacgcgcgtacccgctgtccccgctttccgctgcgcgccggcaccttcaccgatacctcgaccgatcgcccggtccagtggttcttcgacaacctgctgccagaagaaggcatgcgcacgtcgcttgcgcgcgaggccagggtcgacgccgccgacgcgtgggggctgctcgcgtacttcgggcgcgaatcggccggcgcgctcacgctgctcgcggaaggcgagcaggaagcggccggcagcatgcagccgctcccgctcgacgaactcgaacgccgcatccaggcgatgcccgagcgcgcgctgacggccaccgcgcccaagcgcatgtcggcggccggcgcgcagcagaagctgctgctgatcctgcgcggcgacgcgccggactacacgctgttcgagccggtcggcagcgaaccgtcgatgcatctgctgaaaccggacatgcgcgccgccggctatccgcattcggcgatcaacgagttcttctgcatgaagctcgcgaagcggatgggcctcgacgtgcccgacgtgcactttctgcgcgcgccgtccgcgtgctacgtgatcgaccgtttcgaccgcgataccgcgtcggagccggccgcacggctgcatacgatcgatgcgatgcagttgctgaactacgatcgcggcttcaagtaccagcgcgcgaacgcggaagaactcggccgcgcgatcgggcagaccagcacgcgcgcgctggcgcgcctgtcggtgttccgctggacgatcttcaacgtggtggtcggcaacggcgacgcgcacctgaagaacctgtcgttcttcgtcgacgcgcgcggctaccggctcgcgccgttttacgacatcgtcagcacggtcgtctatcacacgcccacgcaccggcccgatcatcgcggcgatcattggccgcactgcgaactgacgatgccgctcggcgcggcgacgcgcttcgccgacatcgacctgggtgcgctggtcgcgttcggcaatgcgctcgggctcagggagaaggcagccgaaaacgagctgcggcgctttctcgaaccgctcgatcgcagcgtcgcgcagacgctcgacgaagtgcgcgaggtcacgcgccccgacgccggggaaatgcgcctgctgaactcgatcgtctcgatgccgatcgcggagatgggccgcgcgctgcggcaggggcgcgggtaagcggttgcgcacgggtcgcgtgccgtccgctcaccgcggccgatgcctgacgaaccggccccggcccgtgatggatgcccgtcaccggcgcgtcacgccgcgagtccggtcggcgacgcaaccgcgacatccggattgaaccgggtcatgcagttcaggtcgagtgcgcgtatctgctcggtcatgaagtcgacgaagatacgaatgcgcgtcggaagatgctgccggctgagatagcagatatagtggccgcgatcttccggcacatgctgcgcgagcgcgacgacgagttcgctcgaagcgatatggtcgcggatctggtaacccgccatctgcgcgatgcccgaaccgttcaggaccgcacgcagcaccaggtccgcgtcgttgaacgtcagccgcgacttcggcaggtatttctgcacgcggccgtcgacgctgaactcccattcgaatatgcggccgctcgcaaagcgaaagttgatgcactcgtgccggcccagatcctccagactctgcggaaggccgtgcgcggccacatacgacggcgacgcgcagagcgccatctgcatcggaatcagttgccgggcgatgatgctcgaatcctcgatgcgtccattgcggaacgacacgtcgattcgttcggataccagatcgaccggccggtcgtcgagcagcagatcgatgacgatgtcggggtaggctttcgcaaacgtttccagcagcggcgcaacgatcttccggccgaaacccaccgccgagctgatccggatgaggccgcgcggcggtccctcccgcagttccagcatgtcgttcatggcttcgacgatctgcgccacgccctggtggcagttctcgaagaatcgctggccttcgcaggtcagttccgtcatgcgcgtggtccgctggaacagccgcgtactcaactgcgcctccagcttctggacgttgcggctcacggccggccggccgacgccgagacgttcggcggccttggtaaagctccctcgctcgccaccgcgacgaacgcaaggatgcccgcgtagcttgcaccgaagctggccgacaatgcgtcggcgcgccctggcaagtcgcgacgaacgccgtgctccgacgtatccgatcgattcatttccgctgcccccagacatcccgcccatcccgactgcccgtcgcaggcgtacgcctgcgcccccaccttcgacacgcgaatcagcttcctgcgagccaccggtccaggccgatgctgccgagtcgcgctgccccgagcggcacgagcgatcgttcctcgacacggccgccgtaatagcgggcctcgcgatcggtcaccaccgcacgcgtgtcgccgaccgacttcaggtagcgcgcgacgatctccgcgaacggcgcgcgatccgggcccgcgatctcgaccgtgccgttcagcggcccggccagcgcgatctgcgcgagcagcgccgcgacgtcttccgcggcaatcggctgaaacagtccgtcgccgatgcgcacggtcccgtcttcggtgccggaatccgcaatgccgccgatgaactccatgaattgcgtggcacgcacgatcgtgtacggcacgccggccgcctcgatcgcctgttcctgcgcgaccttggccgcgaaatagccgttctccggcgtccggtcgcagccgacgatcgacagcgcgacgtgatggcgcacgcctgcggccacttcggccttgccgagattgcgggccgacgtgcggaagaaatccagcaccgcctgcggttcccatgacggcgcgttcgcgacgtccacgacgacgtcggcgtcggtcaatgcgtcggtcaggccttcgcccgtgatggaattgacgccggtgcgcggcgacgccgcaagcgcctggtgccctgcctcgccgagcaacgtgacgacgcgtgagccgatcaggcccgaaccaccgatgacaacgatcttcatcgcaaaatctcctgacgaaagggttttccttggaacgcgcgcggcgtgtgacgctcgccgcctccgatgaaaacggtcatgaccgtcgcatcgcatggcgcaattgtggaagaatcatgtcctatccatcagtgccaagaatcgtcgatcggactggtccatgccgtccgctcccgtcgcccacgagaccgtgatgcccgcccaaacgcccgccctgaccatcgaaatcgaccggcaccatcagttgccgatctacctgcagatctgcgagcgattcagaaccgcgatcgcggcgggccatctgcgccccggcgaccgcgtgcccgcgctgcgcggcctcgcgacgcagctgaacacggcgcgcggcaccgtcgagcaggcgtacacgatcctggtcgacgagggctatctgcaaatgcgcggcgcggccggcacgttcgtctcgccgtccctgccgaaatcgctgacgcggccgacgcccgcgcgcggcgacgagcaggcatggcgccccgacgacgcccctctccgggtgccgggcgtgtcgcgcgagattccgcctccgcgccgcccacagccgatcgcggtcgcgctgagcggcgagccgcgcccgttgcaaccggggctccccgcactggacgcgtttccgcgcaaggtgtggcaccggctcgtgtctcaacgtgcacgcagcgccgaacgcgcgttgctcggctacccgaatccggccggctaccggccgctacgcgagcacatcgccacctatctcggcttgtcacgcggcgtcacctgcgtgccggaacaggtgttcatcaccggtggctatcgcgccacgctggaactcgtgctgcgcagcctcgcgcggccgaacgatcgcgtatggttcgaggatcccggctacctgctggcccgcaccttcctgtccgagaccggtgtgcagctcgttccggtaccggtggacgccgagggcatcgacgtcgagcgcggcaagcagctcgacgcgcacgcgcgcttcgcgctggtgacgccgtcgcatcagagcccgctcgggcacaccctgtcgcttgcccggcgcatcgcgctgctggactgggcggaaaagacgtcgggctggatcgtcgaggacgactacgacagcgagtttcgctatctcggccgcccgctgcaggcgctgaagagtctcgaccgccgggatcacgtgatctattgcagtaccttcagcaaggcgatgtatcccggtttgcggctcgcctacgcggtcgtgcccgagcgcgcggtagagcgtgtcgatcgcgtcgcatgcagcatgaatgccggctcgccgaccctgctgcaggccgccctggcggatttcatcgaacaggggcactttgcccggcacctgaagcgcatgcgtgcgttgtacggcgagcggcgcacgctgatcgtgaacgcattgcggcaggcattcggcgagcggctgatcgtcgagctgccgcccggcggaatccagttcgcggtgcagttcccggacgggcccgacgggccggtcgacgacgtcgccgtcgccgcgcgcgcccgcgaagcgggccttgcgatcctgccgctctcgatctggtatacgaacagccacacgcggcagacgccgcgcgggctcgtcatcgggttcgcgaacatcgtcgatgcggccgaagcgcaccgtcacgcacacacgctgcgcgcgtgcctggaccgctgacgcacggaaattcgcggctgcgcccgtcgcgccgggttccggattggtgtccgacgggaaacagacaatcgccctgaacggctataccgccgccatgtgcaggcctctagcatggaaacgtcgttctttcgtggacgaaccaggaatcaggctgcaccgggcgattgccgtattcgtcatacgatcgctcgacacccaccattcgcggcagacgcaattcgcgtggggcgtgcagccccttcgcaagacgtttcgaccgtcgaagcgcgtcgctgaactcgagcaagcatcatggatgacaagaagctgcaggccccctcgctgtctctcctcgacaggtatcggggccgtgactttcaacccctttacacgacgaccgtcaccgtttccggcggcgagacgggacacggccgcgcatccggcgtggcccgctccgacgacggcaatctcgcggtcgacctgcgcctgcccgccgagttcggcgggcccggcaacgggaccaatccggagcagttgttcgcggcagggttcgccgcgtgcttccacggcgcgctcaatctgctcgggaaacgcgccgaaatggaggccccgatacggccgtggaagtgcaggtgtcgttcggccgcgacccgatggacggtggctttgcattgctcgtcgacgttcgggtgcggatgcctggcgtcgatcgcagcctcgcggaggaaatggtccgcaccgccgagcgcctgtgcccgtatgcaaagatggcgcggcaaggcaccgtcaacatcatgaccgtcgtcgactgaatcgacgccttgcgtgccgcggcggcgtcttgttcgccgacacccttcagccgccgccgcgtgcctgcacgccccgccgcgcatctcgcgacacgcgcggggcgccgtccgatcagccgaacgatgccagcggattacccgctgccagcgcgtcggcgcgattcggcgccggcgggtagatccactgcgtgttgatcatctgcttgcgcgcctttccttccgcgtgcgtcagcttgatctgccgatcccagccttccgagtagacagcgccccactcgccaaggtcgacgcatgtcgcatagaacggctggcggtacgtcagcgtcggcacaccgatcagatccgcggcaacgttgtgtccgccgaattgccccatcacgatcgcgtgctggcacgacatcaatgcatcgtgcccgtcgtcgtcgcaccgtgcccgcgccacgtctcccgccacgaacacgtgcggtgcgtcggcgacccgaagatcggccgtgaccgcgacacgtccgagcgcgtcgagatgcgacgagacttgcgccgccagcgggctggcacgcattccgcctgcccagatcacggtcatcgcctcgatatgcgtgcccgacgcggtgcgaacgccgtcggccgcgatcgacacgacacgcgaaccgagcacggcttcgacgcccagcgaatcgaaggcttcggcgacgtgcgggcgaggattgggcccgagatcgggaccgatgtcgtcctgcgcgccgatcacgacgacacggctcttcgcatccgcgccaaaccactcgcgcaatcgcttgggcaactcggtggcgacctcgatacccgtgaagccgcagccgaccaccgcgaccgtattgcgtgccggcgattccggcagtttcgcgagcgccgcgaagtgcgcgtcgagtgcgaccgcgtcctcgatgcagtcgacggagaatgcgtgttccgcgagccccggcaccggcggcctgctcagcttgctgccgctggtcagcaacagccggtcatacgtgatcaaacgcttctcgccgtcggcgcaagcaacaccgaccgtcttctcgcgaacgtcgatctcctcgacactgccctcgagaaatttcacgccgacggcatcgagcagcggcagcagcggcgcggccatttgctgcggcccgctttcgtacaaccgcggccggatctgcaattccggcttcgggaaaccagcgtgatttcaacgtcactgcccgtgacgccggcaccgtccagcacgcgagccgcgcccagtgcgccccacacgccggcaaaaccggcacccactatcaggattttctgcgacatgatcattgccctcggttgatgtcgacagcggccatccgccgcgcgaaatcatcgtaggggatgctgccgcgtgcagtagatccgcaaccgtgctcacgatgttgccttcgcggcaccaatcgatcgcatgtcaccggaatcgatcgcaggcatgatgtgcggcgaagttcgtgcgttgccgcccctttcgtcacccacctgaatcgtcgatgaggcaaatgaaatgcatctcggaagatcgtacaagctatcggaattcctgatctggacgcgctggaagatctacgagctgctcattttcggttccgttccggtcgtgctgtacaagttcttttcgatcacgtggctgtcgatcccctgacgatcgtggtgctcctcggcaccgcgacgtcgttcatcgtcggcttcaagaacgtccagacgtacaaccgtgcagcggacgcgctcgaaatctggaccggcatcctgagcaagagccgccgctggggacaaattgcgcgcgatttcgtcacggatgaagaggttgcccgaaagctggtataccgccacctcgcctggctgaccgcgctgcgatacgacctgcgtcgcccgcggatctgggaaagcacaaccaaacgctacaacgcggagtaccgccgcttctatcgtgttcccgaatgggaaaaggacatcagggaactgctgccccaatacctgtctcccgcggaaacggcgcaggcgctgtcgtcctcctccatcacgacatgcgtgctgagccttcaaggtacgtcgctcaagacgctttacctggccggccagctgaattcgggtttttacatggagcttcaaagacgatcggggacttcgtcgatctccagtcgagatcggagcgattcaagaacttccctatccgcgccagtacgcgaccgtcagctcgctgttcgtgcggttcttctgcctttcgcttccgttcggtcttctgaacgaattcaatcggttgaacgacagcgtgagcggcttcatgcacggcaacatggtatggctggtcgtgccgtgcagcgtcgccgtttcgtggatgtatacgtcgctcgaacaggtgggcgaaagcaccgagaatccgtttgaaggcggtgcgaacgatgtgcccatttcaacgctgtgcagcacgatcgaacgcgacctgaaggcgatgctcggagaacacgaaagcgaatcgtcgagccgcacgatcatcgcgctatagggcgttcggcgcctttccgacgccgctcgacgcgaattcacgctgcacgtgccgccgtcgatgccctcgttcgggccgcaccgcgtgccctgccgggcaatcctcctttcgtcgattgttgtcgccgagacaacatggtgaggtccttcgcggcgctactgccgcgcgaccacatcgcctacgcttggcgctgacggtggccgtacatggtgcccgatgcgttccggagcacagggacgacaccgcaagcgcaacgcgcgaaaccacgcagcgaatccgcgccgcgtcgcgtcttcacgcgtcattggtcgcgccggcaaacgccgtcgcgacgggtgcccccggcacctcacctaccgaggaacgatccgtgacagaagaagatatccgcagcaaagcgttcgcgatgcccgtccccaacccggcgtatccgcgtccgcccttccgcttcgtcaatcgggagtacttcatcatctcgtatgagacggacctggatgccctccgtgccgtcgtgccggcaccgctgacggtcgaccatgccgtcgttcactacgagttcatccgcatgcccgattcgtcgggattcggcgactacacggaaagcggtcaggtgatctccgttctggacgcggacggcaaccgggccaacttcacgcactcgatgtacctcgacgacgaaggcccgatcgcagccggacgggagatctggggatttccgaagaaactggcctcgcccaggctctgcatcgacggcaaggacacgctgctcggcacgctcgactacggcacgcagcgcatcgccaccggcacgatgggttacaagtaccgcgcgctcgacacggcagcggagcggcgcaagctcgccgacacgcccaactatctgctcaaggtcattccgcacgtcgacggctcggcgcgcatctgcgaactggtgcgtttcttcctgcgcgacgtcgacgtgatcggcgcatgggaggggcccgccgcgctcgagctgcgtccgcatgcgctcgcatcggttgccgatctgccggttcgcaaggtgatcggcgcgcgtcatgtcattgcgaatctcacactcgatatcggcgaagtcgcccatgactacctcgcccccgccgagccgttgaagctcgcggtcaaccagtaagctcccggaggacatatggcactgaatgacaaggtcgcgctcgtaacgggcgcagcaagcggtatcggcgaaatgtgcgcgcgcaagctcgcggcggacggcgcgacggtcgtgatcgccgacctcaatctcgcggcagcacgacaggtcgccgacgacatcgtcgccggcggcgggaaagcatcggcggtcgcgatggacgtcaccagcgaggaagccgtcgatgcgggcgtggccgataccgtgaaccggctgggcggaatcgacgtgctcgtgtcgaatgcgggcatccagatcgtcaaccggatcgaggactacacgttctccgactggaagaaaatgctggccattcacctcgacggggcattcctgacgacccgcgccgcgctgcggcacatgtacgcgtcgaacaagggcggctcggtgatctacatgggctcggtgcattcgcacgaagcgtcgccgctgaagtccgcctatgtgaccgcgaagcacgggttgctcggcctcgcgcgcgtcgtcgcgaaagaaggcgggtcgcgcggcatccgcgcgaacgtcgtgtgcccgggcttcgtcaggaccccgctggtcgacaagcagattcccgagcaggcgaaagtcctgggcatctccgaacagcaggtcgtcaaggacgtgatgctgaaggaaacggtcgacggcgaattcacgtcggtggccgacgtcgcgaacacggttgcgttcctggccggcttcgagtcgaacgcactcaccggacaatcgatcgtggtcagccacggctggttcatgcagtaaggagaacaccatgcaatcgagccagcgaaacaagctgaagcagccccatcggatcgagctccccgcttatgacgaaatcgggctcgtgctgcagggcggcggcgccctgggcgcataccaggccggcgtctatgaaggcatggccgaggtcggcgtggaaccgacgcaaatcgccggcgtctcgatcggcgcgctgaataccgcgatcatcgcgggcaacgcgcctgccgatcgcacggaagcgttgcgcggcttctggaacaccgtcagccagccgaccgacccgctctcgcacgtcggcgcgtacctgtcggcttggccggggcttgaagacgtggggcgcaggtggtcgagcgcatgggccgccacgcgcacactgatcgaaggccagggcggattcttcgctccgcgcatgcatgcgcctttcggcggattcggcaggaagcgtcccgaccaggtcagctattacgacacgtcggctttgcgcgacacgcttctgcggtacgcgaacttcgatcgcatcaacgacgggaacattcgcgtctccgtcggcgcggtcaacgtgcggacgggcaatctcgtctatttcgacaattcgaaaatgcgtctggcgccggagcatttcatcgcgtcaggcgcattgccgccgggctttccgccgtcgagatcgacggcgagttttactgggacggcggcctggtgtccaacacgccgctcaccgagatcatccgggaaagccagcacaaggacacgctcgtgttccagctcgacctgtggagcgcgcgaggcaagctgccgggcgactttctcgacgtcagcgagcgcaccaaggacattcagtattcgagccgcacgcgcgccatcaccgcgttcatgtcgcagaaccaaaagcacgcccagatgatcaaggcgttactcgaacacattcccgaacacgttcggcttgcccacccgctgctgcgcgatgcgcagaaaacagcggacggcagcgccgtgaacgtcgtgcacctgatctacaagaacaagacgttcgaggggcactacaaggactacgagttcagcaaggacacgatgcgcgagcattgggcaagcggcctcgaggacattcgccgtaccttcgggcacccggagtggttcgagattccgagccgggaaatcggcttcgtcacgcgggacgtgcaccgctatcggcaggacatcgacgaacccggctggtcgggcaaggatgcgttgccggcacggcaacattcgccggagcaggaatcgtccgtcgccaggtaacgcgcgtcgacacccgccacggggcagcacggcggtcgttcaagcgcccgcatcgcgtgacgagcgccccggccggtactgcccccgactcgacgtatccgccctgcaagaccggatcaggcggcgccgcggccggccttcggaacaggctacgcggcagcctcaaggagagcatcatgatgtcgcatgaattgatcgcgcggtacggcacatgggtcgtattcctgaacgtgctcgggtcttcgctcggcctcccgttgcctgccataccgacgttgatcacggtaggcgcgggcaccgcgctcgtcgcgcatgtcgggtcgtcgacgctgctgcatttcctgacgatactgggtgccgccgtggtcggcggcctgctcggcgatctggtctggttccagggaggcaaacggtacggcaagcgcacgcttcacaccgtctgcggcctgtcgccgtcgcgcgaagcgtgcgtcacgacgaccgagcgctttttcgggcgctggggcgttcgcgtgctcgtcgttgcgcggttcgtacccggcctttcgctcgttgccgttccgctctgcggtgcgatggccgtccgggtgcgcgacttcgtcctgcacgattgcgccggcattgcactgtgggcgtcgatcggcctcgccatcggcacgctgttcgcctcgcagatcgatgcgatcttcgcgactgtcgcccgtctcggctggcaagcgctcgtcgtgctcggcatcgccccggtgctgtactttctgtatggctactgccgcaggcagatgatggcaaatgcgctcgggaaggcgcggatcagcgcgggcgaattgcatgcgctgctcgcgaacaagccgcggccggccgtgatcgatatccgttccgccgaatggagaacgcgtgatccgtttgtcattccgggcgcgctgatcgccgatgaacgccacccccgccagatcatggagcgctatggaacgaaccggacgctggtcatctattgtgcgtgtccgcacgaagcgtctgctgcgtcggtggccaggcagttgcggctgtccggcgtcaagcttgcattgccgctcaccggcggcatcgatgcatggcgtgtcgcgggtttcgacgtggaaccgatgatcgcgatgaacgacacggcaatcggcgccgccgggcagcagctttcacgcaatgactgccatggcgccttcatgcgccgaagcagcgcgtatcgcccggctcgtgcggcggatgaccgaatcggcatcacgactcttgctgccccagcttcgcgcgtccccgccccgatcctcgacgaaccgggcctcgcgctcccgcgactgcgcgcctcgcgacaaccgggccggtactttgctcgggtacactcatgcctccgccacacgcgccgtcacagcatggacagtcagctttggatcatttgcgggcttacattcgtcatccatgtgatcgcgacactggcctatgcggtgcggatcgccggcgttcgaacgcgccggatcgccctgtcgttttccttgttcgggatcatcgcgctggtttcccggacggccaactcctttcaggggccgttcatcgcgaaacgggtcgaaatggatatcgcgcatcggatgggcagcgggctgctcaccgattttcggctcttcctgctgagcgccaccgtggcgagcattgccggcgccttcctgatcccgactttccagcgttatttcagccgcgccgtcgaacatttccaggtgaatcgttcgattccgcggctgctggtcgacgcctgcagtcgcgctggcgtcaactatcttcgcgtgggcgcacgactgccttcccgccacaacgtcacgcaactgaccgcgagcaccggcgtgtcctggaaagtcatcgtgctgaacgtggcagccatggcgatctggacggtcggtgtgttcgcgtcgctgtatgcgggttacctgaaacccgacctgagggtgacatgcgcgaacctgtcgtccgtcatcaatggcttcgcgaccgtggtgctggccgtcgtcatcgacccgcaggtttctgtcatgaccgacgatgtcatcgaaggccggatatcggaaaacagcttccggcgggccatcacgacgctcgccggtgcgcgagttctcggcacgctgtgcgctcaggcggcgctcgttccggcggcgttggtcattgtccgtgttgcggaaatcatttaaccaggaatggtcgtctgcagatgctgtatcgtaagcaccctcacagtcgcgcagacgggccccacgatctccgtcgagatgtcccagatgatcccactccaccgcgatccagcgttctatcagctccttgccgacagctacgcccggctgcttggccacccctggtgcctcaggccatgcacgtggacgaagctaccgaatggctctatgagcgtgcgccgttcgcggtactcgcgcacaacaccgatcccgacccggtcttcatttacggcaacaaggccgcgcagcgcggttcgggtacagctgggatgaaatcacgcgactgccgtcccggctttcagcagaagctccgaatcgcgaggagcggcagcaattcctcgcacgcgtacagcggctcggctacgaggcgggctacaagggcgtgcgggtcaccaagtcaggccagcgcttcatgatcgaggaagccacgctgtggcaactgctcgacgccgacggcacactgcacggccaggcggttgtcatcccgcgcacgcgtgacatctgattgggcgacccggtgtctggaccagggtttggccgccctgcacgctctacccttccatcgactgcattggtgcggaacgggcaacaccatgcatcccgagtcgatctggtgcgtcggctcgtctttgcctagcatgcaagtacgtgtggtccatcgacgggatggcgctcgtggggattgactggcaggcaagcgctgcgccgttgcgctgattcgcttcgaagaacaacgcatcgcctcgatacccaaggttcgagagccgctcgcattggccataccggcaaccgggaggcatatggagaacgagaggttgcaacctccgccgctgacactgctcgacaaataccgcgggaaggaattctcccgctctacacgaccacggtcacggtctctggcggcacgtccaggcacggccgtgcatcgggcgtcgcgaaatccgacgacggcagtctcgtcctcgatctgcgcgtgcccgccgaactgggcggcccgggcggcggcaccaatcccgagcagctttttgccgccggttacgccgggtgctttcacggcgcgctgagcctgctggcgcaacgcgcaagggtcgatatccgggagacgaccgtcaccgtcgaagtctcgttcggccgcgatccggtagatggcggatatgcgctggttgccaacgtcaccgtccgcatgccgggtgtcgagttgcccgtcgcggaaggtctcgtacgcgacaccgaacgtctctgtccttatacgaagatggcacgacaaggcatatgcggcttcatcgccgtgtcggcatgatgggcgattggttcggaagcggcaacagagtgcgcaccttgccggcactactagctcccgggacgcacgattacgatggttgccgggcaggtgctgcggcgaatcgccatccgacgcgcccatggcaccgcttcaaccgatcaggagaacagatcatgacgcaacgtatcaactactttcagcaatcgccggaactggtcaggaagctcatcgagctggacggcttgtttcagaagacgacgatcgaggcgccggtccgcgagctcgtcgagatccgggcttcgcagctcaacggctgcgcattctgcgtcgacatgcacatcaagatggcaaagattcatggcgagcgtgaattgcgcctgcatcacgtcgcgatctggctcgaatcgacgctgttttcacccgcgagcgcgccgcgctggaatggaccgaggtactgacccgcctccctgcgcatggcgtgccggacgatctctacgcacgcgtacgggaacactattccgagcaggaactgtcggatctcaccgtcctcgtgggcgccatcaatagctggaaccggctgaatgtcgcattccgcatcgtgccgggatcgttcgacaagatgttcgggctcgacaaggccaacctggagtgacgacatgaaacgcatcatgctcgtactcgcgccgctggtatcgtcgctgctgatggccgttcagccggccgtcgccgcaccgcaagcgaaggtcacgccgctgaccacggagccgttgcccgagtatccgggcaaggaagtccagatgatcgtcgtggactatccgcccggcagcgtcgaccccgttcatcgtcacgacgcacacgcgttcgtctacgtgctcgacggcagcatcgtgatgggcctgaacggcggcaaggaggtcacgctccatgccggcgacacgttccacgaaggcccggatgacgtccacacggtcgggcgaaatgccagcagcacgaagtcggcaaaattcgtcgtgttcctgatcaagaacaaaggcgcgccggtcctcacccccgtgaagtaaggtaatcgtcgtcgcggcccggcaatgccgggccgcttctccggtttcaatcgcgacagtgcgtcgaacccatgtgattcgtgtacggcgacgactcgatccacttcggatcggcagccagcagcggattgattcgtgttcgaggccacgctgaggcgatcgggcgacttgaacggatacgcgacgggcgattgcccgatcgggcgccggcgcaccgcggtggcgtcggaacctggcccagttgacacggcggatgcgaccaccggcctgatcctgcttaacacccctgatatatgcactgtgttctcggcggcaatcggccgccgtgaactgcccctcttgattggaatcaatcgccctctcgagcttcgcgatcagccaactcgcatcaaccttcgatgcacttgtctcgaaccccgactcgctttccgcgataccgatcgcggagatgagccgcgcgcttcgcgcgacgcgtgaccagtggccgcgcgcggatctcgcgccggccgcatgccctgtctccgccggtgcctgtgccctccttcatacgcgctcgggcgtcagcggctcgccgcaaaggcatcgattccggtcagcttcgcggaccacgcccacagacgcgccgcctcatccggatcgatcgcatgcggccgcacgccggattcctcgtttccctgcgtgacgaccgcgacgtcgcaatcctcgcaatagacaccgccgatcgccgcaagacgcggcgacgttgccgcccatacctgggttgcggcaccctgggccggcgtcttgaaagtcggatcgaccggcacaccgtgctcgtccacccagccctgcgccatcatctcttcacgtgtcagatgacgctgcagcggcgtcgcgatcttgcccggatgcagcgaataggcgcggacgccgaacggggcgcccagcgcgtcgagctgcaccgcgaacagcgcgttggcggtcttcgactgcgcatacgcgagccatttgtcgtagccgtgtgcgaactggacgtcatcccaacgaatcggcgacagccggtgcccgagcgacgacaccgcgaccacgcgggcgccgccgccatgcgcgagcacgggccacagcccgttgacgagcgcgtaatggccaagatgattgacggccatctgcgcttcccggccatcgccgacgcgtgtctccgggcacgccatgatgcccgcgctgttgatgacgatgtccacgttgcgccgcccatcgacgaaccgcgccacgaacgtggccacgctcgcgagatcggcgaggtcgagtgccgcaatctccacaccgtcgatgccgcgcgttgcttcgcgcgcggcatcgacgccccgcgcgccgacgacgacggtcgcaccggcttgcgccagtgcgcgcgtcgtttccaggccgagccccgaatggccgcccgtgacgatggcggtcttgccacgaaggtcgagatcggccagtacgtcgcttgccgtcgatgctgcgccgaatccggaatgaaggggtgttgcctgctcgtcatcgaaggctcctggaacgatgcgtgaagcacgcgcccgcctgtcggtcgcgtcactgcacgaggccattttccggcggcgccccggactgtgaatgcaatagaatccgatttttcgtcgagatcgtccggagcttgaacgtggatcccctgtcggaagtgctgtcgctgctggaaacgcgcgactcgtatttcaccggcctgagagcaggcggccagtgggcggttgccattccccgcccgagggaatcaagttcaatgcggttgtcgagggaagttgctggctgaccgtcgacggcgccggggcgccgatccggctgcgcacgggagactgcttcctgctcgcatcgccgcgggcattttcgctggcgagcgatccatcggttacgccggtccctgccgccgacgtgtaccggaacgtcgaacacggcatcgcgcactatggcgaaccgacgaactgctttctgatcggtggtcgcttctcgtacgaggaaggcatgccgctgctgcttggcagcctgccgcccgtggtgatcgtgagcggcgactccgagcaggcggcggtgttgcgctgggcgctgcagcggctcgcacatgaattcggcaaaccatcgccgggggcgtcgctgatggttcggcatctcggccacatgatgctggtcgagatcctgcgccgctacgtggacgacggcgcgaacagcgatgtcggatggcttgccgggttcgcggactcccgggtgagcacggcgcttgtcgccattcatgcgcagcccgcgcgacgctggacggtcgacgaactcgcgacctgctgccacgtatcgcgttcgacgttcgcgctgcacttcaagcggcggctgggattcgggccgctcgagtacgtactgcgctggcgcgtgcagctcgcgatgcgggaactgcggcgctcgaacgcatcgatatcggcaatcgcgcaaatgctcggctacgactcggatagcgcgttcggacatgcgttcaagcgcatcgtgggttgctctcctcgtgcctatcgacatgacatcacgggcgagtcgggcggctaacgtcatcgcccggcacgctaccgcctctgttggcgccccagaacccgtttcagtcacgccatcgatgctgccatcctccgatgggattcattccgatcaacatcatcgggataagttttcttatcacaacaccactataggtagataaaacttgcgatccggacaacgcgcgaccacgagcgtccccgtcgtgacggccctgtcgaaagttggcagaagcctttgcgcagcctcgccggtgacaacgtcctttctgtctacgcccggctgcgagtgcatgcgcgcttcgtgccgaatcccgtttcgtggaacgccaatcgaatgatcgcaacggcttaccgcgcgcatcacggaatggcgtgcatcggctggcgactgacgccgccttcgcactgacgtccagacgcgggcccctgtcgattcgacggctgtcacattttcggcaagcaacgtcaggtgcatgcccccagccccatgtcgcggaatcgggagaggtgtcgttttccgtataaggcatgaatggtcagcgtcgactggttgtcgaggcagttgcctcgtcgcggtcgaaataagatggacacccgatcgacgatgcgcgtatgatggtttcattcgagcgcccgtttgctgtttgcccgctcgccctccactcgccaccgtgttgcgtcgcgtaccgcctcgctcgcaacgtttgtcccttacacaccgacccgccgcgccatgcatcaggcgatgctggctgcatacgctcgtccttgcgagtcgccgcaatcgatcgccaggagttcatgatgagcatgcatatttaccgtggattcgagatctatccactgatttacccacacgtgcctgcgttggatggcaacccgcataactacgatgccggcttcgacgcagcggtcaagatttgtcttcgcggcaccaccgatacgctgacgcagagccagactttcaggcttctcgacgacagtccgttcgataccgccggtgacgcacgtcgtgcgtcattgcgctatgccgaaagcgtcatcgacgaaaatcgcgaaaagcagggcttcttttcgagcgccgtctgacgcgactcacgatggcaaagtaactttccagcaatttggaggacgaaatgatcgtcgacgaacttcttgacctgatcagagggtgcaaggtcactcggagcgacgctgtcctgcccgctggaataacccattccgcgctatgtcatcaacaggagctgcagatgttcgcggctgtgcgcgcattttcaatcggagccgggtattcggaattcgaatctgacgagatcgcaagcaccgtcatgacacgactcggctagttttcccgtcgaccgttttcaaccaggagttacatgacaaccatcacactgaagatcaacgaaccaatcgatgtcgcgctgcgacgattccggcgcagtatcgagaagaccgggttgattcgggagttgcgcagtcgcaccagctacgaaaaacccacgacggaacgcaagcggaaaaaggccagcgccgttgccaggcagcgcttgcggacgaaacgcctgatgccgccccgcaaaatgttctaggaacatcgtgcacgccgtgccggccggggcccgcttgcgtcgccatcccggcccccggcatgaattacggtggccggacgacgcaggcggcaagccggccggccgtctcgcagccgcaagaaggatgatcagtacgctcgtcacgccgtgcagccgtggtgctgcccgaaattgactccagcatcgcctttcgagcgagcgcacgtgcgctcgccgtgcagcaagtcaaaatgaaaaccataatcagaaggcgaaaaacatgagctggtactgcgacgcggaacgcgagttggcccatatcagacgatcaatcgggctgcttgagcaagcgcaacacgcgttcatcaacagatcgaccgtcaacgatccagcgtactggagagtcaagctcaacaagctccgcacgcaatccgagcgcaacaaggttctctcactccaggtggacgaactcctggcccgcctcgaacgcattcaggattcacgctcccgaagataggagccgactccttcttcgcccctcttttccgggtgcacgcgcattgcagggagcaatcccaggagcaccatcatgatcgacgccaacccaggcaacacgtttcgacaccttccactctcgcccgagcaggatgcggaaatccggcactatataaagaaaaaggcgcaaagggcgaagcgtgggacacccctgagttggcgatgatgctcggagacatgctttcccctccgccaagcgacgaccagacgccggaggctaccgtcgaagaagtgaaactggcctgcgaatatgcattggcctcgatcgacgaagccatggagtccgtatccgcacgtgaagaacgactcgccgcgatggaagccgaggaaatgaagcaccccaggcagtaacgcatccacgatgcccgaagctcgagccgcagttgcgccaccgcttctttgccttcagccggattgaacgacccggccatccctccgcccgttacgtcgcgtacgcaatcgcatcgtcactcgcctcgaaaaacgcgaatttccgcgaacgccccggctgcaacggggcacccgtcgttcagcggccgatcggcaaccccgtcggctcgatccagcccagcttgtaagcgatcagcagcgacaggaacagcgtgaccgacagcccgacgcgtgccgcgagcgaccatgccatccgcttggacttgccgcgatcgtgattcatgaaatacagcgcgaagatcaggctcgcgatgatcatcgcgaatgccacggaaaccagcagagttttcattggtgatgcccttgaagatctgaatcggcctgaatcagttcggccagtttttgccgctcgtcggcgagcgcgccgacgcccgacgccggccagtccagcgcgacgccgttgcccagcgaatcgcgcacgagcgcctggtagcgccggtcgttgatccggccgtggtccatcgtttccgagatctcgcgccggaacggcagcgggaaactcgcgtacgcgcgcgacagcgccgcatattgtctcgcatcgatctctttcgacgatggtatgactgtccagatcaccacggccacgatggccgtgaacgggatcgcagtgtagcgaaggatgaacttgatcggggtcatgaaacggtgggcagaagtgatcgcgaatgcgggcggcacggcaatgcggcagcgaagccgcggccggtccgcgcagcacgacattgtactgtcagcctcatacggctgacagagtatgataatgacattatcatgtacatcacatgattcaagagacccggcgcccgcacgcatgcggcgttcccgccctgccgcccggcgccggttttcatgtccgtgcccgcgatccgcggcgattgagcgaagccaccatgccagcgcagtactttcgaaacctgacgggaaaacaccgcagcgcgaacgcaaaccgtcagctcgggttttcgttggcgttcgtcgccggcgcggccaatgccggcggcttcctcgcggtcaagcaatacacgtcgcacatgagcggcatcgtatcggcgatcgccgaccagacggcgctcggcgacgtgcggctcgcgctggccggcatcagctcgctggggtcgttcctgatcggcgccagctgctcggcgatcctcgtcaactggggccgccgtcgcggcctgcacagccagttcatgctgccgctgctggtcgaggccgcgctgctgcttctgttcgggctgctcggcagccatctcgcgctagggaaaccttcttcgtaccggtgaccgtaacgctgctgtgtttcatcatggggcttcagaacgcgacgatcacgaagctgtcgggcgcggagatccgcaccacccacatgaccggcatcgtgaccgacctcggcatcgaactcgggaagctgttctactggaaccggtcggcgatcgacgtcgacgcgcatgcggtggtcgccaaccgctcgaagctgcggattcatgcaacgatgctttcgtcgttcttcatcggcggcctggccggcgcaatcggcttcaagcatgtcggctacgtatcgaccgtgccgctcgccgcggtgctcgtcacgctggcgatcgtaccggtgatcgacgacctgctcgcattggtccgcagcaagcgctgagtgcgcacccggccgcgtttcccgcgtgcccggtagtagcgccaaaggctcatcgattataatttgattaacataccgaccaccctcgccccgcaatggaaacaaaaaccgcccgcctgaccgtcctgatcgatcccgcgaagaaggaagcattcgagatgctctgcgcagagcaggatctcacgccttcgcaagtcgtgcggcaactgatccgcgagtatctcgaccgtcacggcgtgacgtacaagaccaagagcgcgctcggcaagcgcgtgaagtaagcgcggccgcgcactcggcgccgcttaacgccgcttacgcgccaatctcccaccgccccggaggctgcgtacgctgcaccagccgctgcggctcgatgcactcccggccttcatgcgtctcgccgtggccgccagcttgagctcgccggcctgtgtgcacgcaagtgcgcgttcgagcaggatgcggagtgacggcagccgctggccgcccttccacgcaaatgcgatgtagttgttgtcgtcgccgcacggcaccagcgtatcgacgcaccgaacaccgctcgcagttgctcgagatgttgcggcaatgccggatcgtcgtccatgaagttgatcgccagtacgccggtatcactcaggcgcgcccggcatgcagcgaggaatgccgcgcccgtgcaccggccacgcatgccgtccgcgacgaacgcgtcgtgcaggatcacgtccgtccggacatccgccctttccaggtgatccgcggcgtcggcgcacaccaccgtgaaccggccgtcgtcggcaggaatcctgaatacgtcccgcagcgcgatcacgtccgggttgatctcgaccgcgtcgatcgccgcaccgggcaggtgccggtagcagtacttcgccagcgaaccgccgccgagcccgagcatgcagatgtgcgcaggctccggctgcagcagcagaaagcccatcatcacgcgtgtatagccgagttcgagccggcccggatcccggagcgacatgaagctctgcgtgccgatatgatcgaaatggagcgaaagtgcgtgctgcgtctccagcacgaaaggccggccgtcgttcagcggcgtcgccaggaacctgacgaacgcatcgtaggaaaatcgttcctcggccatggtgggctgtcgatcaagcagtcgattggcgcgggtgcactcagaccttcttcaggtagcaggccttcagcatgaagccgcccatgtcggtcttgcagtcgacctcgtgatcgccgccgacgagccggatgctcttgaccttggtacccatcttcagcgtgatcgacgagcccttcacgcgcaagtccttgatcagcacgaccgaatcgccatccgacagcacgttgccgttcgcgtccttgacgacgtcgccggccggctcgtcaccggtttcggcgccggcaccggccgaccattcatggccgcagtccgcgcatacggtcagcgtgccgtccgggtaagtgttttccatcgcgcattgcgggcaggcaggggcggcgttcattgcagcttccattcaggaggagttgggtcgtcgataaaaatgccgggcgcgctggcagcgtcgcccggccggcctgacggcacgcgccgacggatcggcggaccgccgtcggcgcacacggcattataatgcaattcacatatcttgaccgctgtattataatcaccgctttcgcgccgttcgccggatttgcaacccgtttccacgagaatgccggcacatccaagcaggatgcacacaccccggcctcgccgacggctgctccgggtttcgcgggaaagcgtgtttcacgcgcgccaggcgcaccgctggcctggcaccgcacaccgattctccgttcagaggctttccgacatcgtggcaaccgtcgtgtacgttgaaatcggccccgcctggaaccgcaaccgcggcggcgccgcacgaaaagcagccgtcgacgcggcgcgcggcttcgaaagcgacatcctgctgatcgcgaacgggatcagcagcgacgcgaaggacagcgccgccatcgcagcgctgcaggtgcacggcggcacgtccgcgcaagtgctggccaccggccccgacgaggaggcggcgctgcaggcgctgctgcccgtgctgcaagcgcgctgatttgcgcaccacccggcgtcacggcatcccgcccaccccgaatccccttttcacgaggaagcgatgagcgacaacttcacgtccaacaccccgaacctgtcggcctccgccatctgggcgctcgagcgcctcgccgacgtccgctacgggcgcgatgcgcccgcgctcggctggtcgatcgcgcgggaactcgtcagcgcgggcttcgtcagccattccgcgcacggccgctccggcgcgtcgatcacggccgaagggcggaccttcctgaaaagccggaagtagaccgtcggcggcggcgaatcgacttgatccttttgagcatcacaatggcgattttgcgccttatgaggatcgccctgcgcttctaaagtggagtcaccccgaacgaacgggcgtcaactttccgatcaaggagccagtcatgagccgcatcgccatccccgccatcgaaaccgccaccggcgcaaccgccgacgtgtacgcacaagtccgcaaggtcgccggcggcactgtccccaacctgttcgccgccgtcggccatctcgcgccgaacgcgctcgcggccgtgctcgacgccgaaggcgtgctcgccggcggcacgctgaccaggcaggatctcgaaacgatcaagctgctcgtcagcgccgataccgggtgtgactactgcgtcgccgcgcacaacctgctcggcaagatgaccggcctgtcggccgacgcactgcgcgcgatccgttcgcgcgagccgaacaccggcgaagcgaagcgcgacgcactgatccgtttcgtgctgaacctgcaacggacgagcggcacgatcaccgacgacgaattcgccgcgatccgcgaagccggctacacggacacgcaactcgcggaaatctcgctcgcgatcgcgctgacgatcttcaccaacacgttcaaccgcatcaacgacacggtcgtcgatttcccgcctgtgaagtaagtcgcgcggctgcaagagcatcgggacggcatgcggtgccgctgccgtttcgatcgcgcccgtcgccggctccattgccgcagccggcgtgccgtttggatgacggccacggcgctgcttggggatcggaaaacctgaggtgccgcgctgtcgccgagttgttcgtcgagccgggcaaccgtagcgataggcccggcatcgaaccgtgcgtcgacatctggccgatccgtctgcgagtgcatcgaaccgcaacaggcgccgcctccttcgcatttactccgcatcgccggccacgccgtcgtccgatgccgccgcgtcgcgcggaccatcgaacgactggcgccgccattcacctggcgtcatccccgcccagcgcgtgaacacgcggcgaaacgcagccaccgactgataaccgacgtcagccgacacggcctccgcgctggccgacggccggcgcagcgcattcgcggcgaggctcatccgtatatccgtcagcagatcggcggccgagtgaccgagtttcgactggaaatgacgcatgaaggtcgcgcgcgacatgctgcacagcgcggccagttcgggcagcgtccacggccttgccggatcgtcgagcatcgcgacgatcgcgggcgcgagacgcggctggccggccagcgccagcaggccggtcggcgcctgccccgattcgctgatcgcgcgcagcgcgagcgcgaacagcgccgccgacagcgcgtcgaggatcgcgagaccgccgagttgccgctcgagcgattccgcgcgcatcagctccacgagggcggtcagccgcgcggtggcggccagcgcgtccgccgtgcggctgtccgctaccgcgcgcacgacgagatcggccggcaggtggcgccggatcagccggtcgtgcggcggcgcgaccacgaaacgtccgcacagcatgtccagccgctcgccggtacccgcgttctcgccgatgaagacgtgaccgccgggccgcttgaccgccggcaccggcggcaacccgctgccgtcgtggagcacatgcggggaaccgtgcggcaacagcacgagatcgccgccgccgagttcgcgcacggagccgtcgtcgggattctcgaggatcgcgcggccgcgcagcaccacgtgatacgggatctcgcacgcaggcgatcgttcatacgtgaccgcccacggcgcgccgaacgcgcagcggatttcgagcttcccggtaaccgtgacgagtgccatgaagcggctcagccagtcggattcgagtgtcatgtcgagtggtgaacgcacatcggaagtgcggcgtgcgccgcatgaaagtccgattatcgcgcggccagccgctgcaatcgcgcacgtttccggttcgacgccgtcgatgcaccggcatcactcgcggccgccggacgcgacgcccgccgcgacaagggttttgctatcattcccgcgccctgtcttgccgaaatggacatgcccgctcgcagcgtgccgcactcgcgtaccgccgatcgcacgccgcctctcgccgaccaacaccgccgcccgacctgccggcgagcgcgcgaacgggccccgaccagcgcggcgtcgacgtgccgacggcccggccgtcccatgctccccttctttctcggaaaccacgatgccgcctgtctcttccccgcccgttctcgacacgccgcgcctcatcctcgaaggccatccgctcggcgacttcgatgcgctcgccacgatgtgggccgagcccaaggtcgtcgagcacatcttcaacggcgagccgtccgcgccgcgcgactcgtggatgcgcatgctcgcgtatcgcgggctgtggccgctgctgggttatggctactgggcgattcgagagagacgtcgggccgttatgtcggcgacctcggcttcgccgatttccaccggctcatcgagccgtcgattcgcggtgtgccggaaaccggctgggctctcgcgacgtgggcgcacggcaagggctacgcgaccgaggcgctcgcggccgcgcttgcatggctcgatgggcagcaacggttcgagcgcagcgtatgcgtgatcgcgccgaccaacgtggcgtcgattcgcgtcgcggagaaggcgggttatggcgagccgcagcgtatccgcttcaacgacgccgattcgttgctgttttcgcgcaagcgccgataggcgagcgtggttcgtcggtcacgtcagtccaaggccggttcgtaaagcgcaggaagaggccgttgtccatcggccagcagttcccgctttcgtcgagcagaatccagtcgcccggcttcaccggacgccagccttccggcgtcgcgactgcccacgtgtcgtggcgccgcgccacccggtcatggtcgccatcgacgaaccatcgtgtggcatcgacgtaggcggtacgttttctgaatttcatcctgccacccaagaaagcggatatcagcgtcgcgctcaatgacggagcgcgaatcgcgtgtcggcgcggggcgcgcatcgcgatgccgcagcgtccgcgtcgagcgcgcgctgcccggccttcaacgcatgcgtcgccgcccgcgtttcgtgcaacgccgcccagctctcggcaacgagcgcctgcaacgtgtcgcgtgcgacgatggagatccggacatcggtctcctgcattctcctgagcgccgacacgacctcgtccggctgatcgggcgccagcgcaagcacgaaccgcgaacgcgtctcggcggcccggacggccccggcccagtcggcccgcgccaccgcggcttcgatcgcgttcgtgagcgtttcgagactctgcacgacttgccacggcatcatgtcgccttcccgtcagttgcctgtcaccgtccgcatgacggacgaattcgcggcgcatcatgcgcgcgcttcaggaagcgaaattgtagggaacgatacgcggcgacatcggtaatattttgtaatgatatgtcgagtaaccttgcctggcgtcagccgaagtaaagttggtgcgttttgcgaagtaaagtctgaacttgggcgtttttcaaaaatttgccccggtgcgcgcgaaacgttccctttgcaaatcaatgatataagttgatttgggaagtaaagttggaccttttccggggcagttacgatcggaaagttcgaacccaccgaacgcctgatttcactgtcgtgcccgttacagcgccggcagtcgcggtcacgcgctccgcggaacccgagtttgaatggataatcgtgccgtcatgataatgaagattttatctcgcggccacccgccgaaacccgcacccttctctgccatcgtgggcgctaaccggctgcgggcgccggaatcggcgaatgtttgccgctggcgatgaagcgctgcagttgctcccacgcctcgaggtagcgaaacttgggcgcggccgccagttgctcgtcgtgcagcaccagcacgcgttcgaccaccgtttgctcatggtcgagcaacaggcacggctgatcctgctcgatgcgcttgatacacgcgtcgagcgcggcctccgcacagcggtagggctcaagaccgccacctgcatgaccgacaacggcagcgacaggtgccgaatgaacaggcgcatgcgctcgagcgagctcatcttcgtgttgacgaacgggtgccgcggcgccgcgtgaatttggtcccgcaattcgcgcatttgaaccgcgggaaggcgccgttcgggcattcatcgaaacgcgtctggtgactgccgcagtccgggcaatgcggaggtcgatggctgagtgaattcagttcgtcgaattcgcgcgtcagacgagctgtcaaggtgaggtcttcgcgcgcgccgatttcggcgaaggccagcggcacaggttccagttcggtggggcggccaccgggcctcacgcggcgctcccacttgccgctcgggtcgagctgcaacagccacgcgcgccaggccaccacacgttggctgatgtcggtcgacaggctgcccatctgttcgcccgcatcaacgcacgaaatcggctgcgacagcagggacacgaacagatcgagtttcttgaggtgcttctcgccgagcggggtgtcggccgtgcggctgaagtaacgccggcaagtctggcactcgaacatcggcagccgaccgatggggcgcattcggaatcccgcactgatgatgtggccgccgccacagcgcgggcagcggggacgcggttcgtgactcgcggacaagatcctgtcgagctgggcggtcagaaacgccgtcagttccttgtcctcgccggcggtatcggatcggcgaagtgtcgggtggctcgatcgggcgttcatcagaactgggcggttagctggaatccgagcgtgacccggttcgtcggaaagccggagggtttgtacaccggcgtaccggcgaacaggtcgtagccgtagccgccgaaacgcgtcgcgacgctgcccttcacgccgatcaccgcgcccgccagttgcgtgccgaccagcgcgaccggctgcgggccccacacacggccgtagtccaggcccgcatagaccgccatcccaatctgtccaatcggcgcctgcaactcgttgcgccagtagaagccgcgagacgccgccagcatcgtctcgccgtcgaagccacggacggtgtagcggctgccaatcgtcaggtcgtcgatgtaatacagcgtgttgccggtgtactggccgtggaacgttgtcacgtagcagaacggttgctgcgcaatcgcgaacggcaccgataggttcgcatcgagcactgccattttgtagcgataggttgggccgccgtcggccgccaacatgtcgtcctgcgcgccgaaagcgccgatgccctgccgatacgcgagcgtgccgtcgaactgcgcgttgccgaaatagtggcgatcggtcaggccgaactcgacgaacgtgttgttacggcgctgctgcggaatctcggtgtcctcgatgaagctctgcccaaaccgccgcgacaatcgaaactgcgcgccgaacacgtcgttctggctgcgcgacagcacgcgattcagcttgaagtcgaccgtcttcgaattgccgctcgcgatgaagttctggttcacgccggcgatctgctggtaatacgtgttcgtatacgccgagagcgttgcggtccagtagccccacgggatcgaatagaagccgttccagccgtgcgagccgagccgcttgtcgccgaactcgagatcctggctcacgccgatgttgaagatgtcgttcaatccgagtgggttgtcgatgccgagcgacaggttgccctgcaggcggccggtcgctcgcgtacccgagttgtcgatcgacgcgacgacggtccacggcttggcgcgcttcacgtcgagcacgacgtcgctttcgcccggcacatcggccggcacgatctgcatcgacacgtcctggctcgacacgcgcttcatctgctcgaggccctgctcgaggtcgcgcaagttcagcagttcgccgtcgccggtcgggaaggcggttttccaggtgcctcggagcttctcgtcggcgaaacgcacgtggcggatcacaccggggatcagagaaaacttgagggtgccggtcgacagatcctgttcgggcagcagcacgcgcgtcgtgacatacccacgcgccaggatcgcttgcgacaggcccttgacgagcacgtcgagcccttgtttgccgacgcactggccggcgtagtgctcgagccattcgcgcgcgaatgcgaaacgatccatcggcaacgccgacgcgccttgtgatttcagggaagcgggcagcgcatcgggtacgtcgagtgcgaaacgctcgatccgaaagcagggcatctccgacggcagcgtgggataccctgcgcttgccgtcacgttcgatcgtaccccaggcgcggtgacggttcgctcgcgctcacgtgcctcttcttgctgtcgggttttctggtcattgcccggaacggtcaggcgcggcgcttcctgtgcggacacactgatcgcgataagcagcagcgctgccgcagcagaattccccggcgaatagttctcatgtgtttttctagatatctgatcgttaactacaattcagtcgagcatgttataggtgcattatttcatgaaaatttataaatatatattaatgattattttgcaataataatgcaatatattattgccgtggcttttccgtctcgtcgttcttcacctcatagctcttgcgcgcctttttgtagctgttatcgaagggtttgatcttcaacatcgcggcgcgacttgtaaagccccgatcaaagccaccccgaagccagccaataacacaatccctccgaaaattgatggtggaatgaatttgactgcgacatacatcgccaacactcctatcacaatcaaactaaacctgacccatcgaggaaaattcccatcctcgatcatcttaatttttcgcaccattccctccagaatttcccgttgtcgatttcacgacaccttgccaataagaattgagcatctcttgaaccttatttgatatatcgctgccgttcatagtattcgacactccattgataaccgggccgagaaggggatatttctccgatgctgcattcgacaccacgttcagtatgccgccaaccccgtactgcccaaagttcggactcaccatctgcccgatagcatcagcgccgacaccaacggccgtcgccccgaatgcaatttgcgcaaacaatggagcaaagggagacggagcagacgccagtgcgccactcgtcgacccaacccacccggcagtcgttgacgtggccgacgccaaatcgcccgtcgttgacttgacgtaattcacgtcggtttggttcggcagacgagtaaatggccctgtcaacgtgaaatgataatctggcttcgccggctgatcgtagctgaactgactcggcacctgactaggcgcagctgaatccgcgtttgccacgatataagactgcaactcaagatttgcggtagccgtcttctgagttaaaaccatcttgccatcggccgtagccggtgcgccgacccattgcgcacccatgtcagtcggtgtcgtgccaacgagcgtcgccggcgcgccggattcgtggatcccattcacggacacacccataatccgcatctgatcttcgatctgcgcttgggtatattttcctttgctcttatctgccagctgcttcgcaagcgtcttttcctcagggtggagctgccgattgaaccgatcaacgttgtacccagagaacgcccccgattcaccgcccaccgccgcacccgccccggtcgcaagcgcgttcgccacgatgttgcccagcgcctgattcatattggcgttgccggtcggatcgctgcctgcgatcgcgctgctcagctcgttcagcttgcccgacgcgatcgacgcaatcgccgcaccggctgcgccgcctaccgcgttgcccccgccaaccctgttaccaatgccgcaccggcgccttgcatcagcgcccggttcgctccgccttccttccacgcgtcgacaccggcctgatcgccattcttctcggcttgccgtttcatttcgtccgcgtagtctccgatccggcgcgacaccgcttcaccggccgcgctggccgcagccatcatgtccgactgattggccagcaggttctgcatgtccggaagtttggcgaccgtaccgttggtattcgtcgtatcgcggttcaagctggccacatcctgcttctggtttgccgaatccgtaatcgtaacggtccccgcactcacgccgctcttcgtcgtcgcgctatcactgccgctgtcgttctggccaagcatgggtgcagcgccacccgtattcttgcccgacgtgctgccatgcgtgctgtagttcatcccgccgtcgccagtcgtcgcgcccgcgctgaagccgctcgaactcgcatcgtagtgcgactggttctggacgtccgagaaggacagcgaacccgtcgtcagcgaattcttcgacgcatccgcgccgctcgcgatcagtccgcccttcaggtcggtattgccggtgacgttgatattgaagccgccgtcacccgcgtgaattccggcttgctcgttgacgcccgcataactacccgacgcattgcccttgctctggctgaagctcgcgctggcgccgccttggctgatgctgaagccgccgcccgaactcgactgatgcgccgcgctcgtcagcgtatcctgcacgctgacgatgttcaggttcccgcccacatcggcgttcacttgattgcccttcacgttcgagccgatgatgttcgtatcgccgcccgagataatcgtcacgccgtttgcagcattcacatggctgttgttctgcgtggccagatcgctgttaccatcgccgttggccttcgacattgccgcggaaacaccgaacccgcccgtgccgaccgacacgcccacgctcgcgctcttcgactcgttcgtgctgcgagtcgaatccgtatccgtcgtattgacgatattgacctgatttttcgccgccaggatcacatcgtttgcggtcacgttcgagccggcgatcgtcacattgccgctgccagcctgaccgttgccggtcgccgcgaacgccaccgttccgcccgcgttcacattcgaaccgcgattcatcacgctgtcttcggagaacgcgctcttgctatgactgctgccgacgctgacctcgaccttgaactgaggcgtttcgcccgcccccagcgctcgaaccacatcgcccgcggcaacgttcgcatcccatgccgcactcgccgctgccatcccgtgcagcgccgcggcccgaccatcctggctattgctggacgcacgcgattgaccaacggcattcgacaccgcgtcgatcaccggcgccttcagtgccagcgtcaggccgctcttcgagacttcctgcgtttcaccgcggtggttcttgtcctgtgctgcgtcgatcgtcacgttcgcgcctgtcccgctgagattcttcgctgcgatcaggtcactgcccgtcacgtgcaggtcgtttccagccgtgatgctcaggttgcccttcagcgaaccgatcgtgctcccgttgttcgacacctcggtcgtctgactagttgtcttcagcgagctgctgcccaccgacaccgacagtccccacccgacatcagcccggattccttcttgttgtagtagctcgacgactgcaaggtatcctgcgacgtcgtcaccgtcacgttacgcgctgccgtgagcgttacgtcattcgttccgacgatggtactgccctgaacgttgacgtccttcccgctgacaatgttcacgccgtccgccgataccaggctgccgcgattgagcgtcatcgtctgatcgataccgctcgcaaccttcacgccgctcaccacattgctatggctatgcgtttcgtgcgaattcaactcgtgcgtctcggttgccgcgccgatattcacatcgccggccgccagcaggttcgcattacccttatccaggctgatcgtgctaccgctgattgtaagatccttgcctgacgccaacgtaacggtatcgccgcccttgagcgtcgtcccggacagtgcctgatcggacgtgtgcagcgtttccgcgtagctgccgtgactatcactgcctgaactgttgctgttgaccgtcgacgtcgcgctcgccgcgccgagcgtcacatcgcccttggcggcgatcgtgccgccctggccgaggtcgatctgcgcgcccttggccgtcaaatcaccgcccacgccgatgctcgactgcccaccaaccgtcaccgaactgccggtgaccttgttgatgtcggtgttcgacacaccgttcgcccgctgcacgatcttgtgctcgcccgtctgcaccgcgccgagatcccagttgccgccgacgttcatcccgaggttgccgccgaccgacaggttgcccgcgttctgctggaagttgccgccggtgacgatcgacgcgttgcccgcgacatccagtttggcaatgggcccgagcgtcgtcaccacgctcgtcgcgccgtcccgactcacgcgcgcattcgtcttcgtcgccgtgtcgagaatcaagtccttgccggcatcaagctgaaggctgcccgccttcacgttcgccgacgtcagatcgatgttgttctccgtcttcagagacatcagcccaccgctttgcagcgcgccgaatgcgttgtcgatctgcttgccctggattgccagcgtgttgtccgccttgatcgtgccactgttcgtgaacgactgcgcgttctggaaatcgatgttcgttgcgctgatcagcgggccgtcgatgttctgctggctggccttcgcgagatacacgacgggcaccaacaccgactgaccgtcgaccacacgcgtttccatcatgattacgttgctggtcagcttcgatacctgatcggcagacaggctcgcgccgatcggaagatcgagcgacttcgacaggctcgcaccggccgccatcaacgactggtacatcgtctccaggtcggcgtacggcccgagtaccgccttgccggtcaacgacgtgacttcgttgcgcacaagctgctgctcgtagaagccgtcaccgagtcgcttcggaatatgcgtgagatcgacgccaagctggccgaagaagtagtcgctcgaaatgaaattcttctggttcgtgaacgcagggttcgtctcgatcacatagctcgcgttcggcgcggtagtcggcttgaacaatccgccctgcggaatggcgagattgttcagcacgttcagcgccgtcgcgctggcgatgatcggatcgaccggcgcgggcgcaccaccgtgcacggacgacgcccccgatttcgcaccgctcgcgttcccactcagattggtaggcgtgagacccggcaccgactgtcccggcagcaagccgagcgacggaatcgatgcattgcccgccgagttgttgacactcactccagtaccggaaatcgtgccgttcgaattcaacgtcgcatcgtaacgcggcagcttgtagtctttgatcgatgctggcgccgcctgcgtgtagccacccggccgagagccgacaaacggcgcattgccgaacggaagcttccagtcatattcggaattatcgtaattgttgtagtgatattgccccgagtaggaaaccgacacgcccggcagtttctggccggacgccgcccagccgtcggcgtcgtagcgggctggcatcttgatgtcgccgaccgccgcgatgttgctccagtagttctgcagcgtaccgaccgaagaggcctcgatcttgccgcccgacacgatctgggcagccgggctgatgtccgttacggtcgtcgccgtcgcgctgtccgcatagtaggtcgtgaactgatacgtgctgttccactgaccgccgtgaggcggctcggtgtagacgccgccgatgctgtacggatccttcacgccaacctggccagtacggccgctgatcggaataccgaactggccgagcagcgatggatcgatcgaactcgtcgaggtcttcatcacgcggcgcgtgctcgtcaatttgtccgcatgcaattccatatcgccttcggactgaatcagcgcggacacgttgttgaccagcgcggcgttcgtgtaattgccgcttgcgtccttgcctcctgccagcacgaccttgcccattccgaagatcgccgtcgtcgccatcgagtcggtggccgtcgtgtcgtcgcggttttcgatgtcatgcgcgaggatttcgagcataccgttgctgtccgatccgccgatcaacgcggtcggtccaaggttcgagatcgtattcgtcgcgttgagcgataagctggcgccgaccagcgcacccgtattggtcagatcggtcgactgcgtacgcagcaaaccaccggccgtcagggcgcccgcgttgacgatgttgcccgcattgacgctcaggttgttgaccgactgcaggttcgcgttgttcgtaaaggtgccgggcagcgtgaaggcgagatcgtgaccgacgttgaactgcgtgtcggatgccgccgtgtagtcgcccggcaggttcacgttggcgtcgtgcgccgcgctgtatgtgccgccaccttgcaacgtggccgctgcgaccgacaggtcgtgcgtcgagccgatctggccgttcgtgttcgtgaccgcgccggccgtcgtaacgttcacgttgccgttcgaattcgtgacgttaccgataaagccgccgctgttgtcgagcgagttccctggacatgcagcgatgcaccactgagctgaccgccctgcgtattgctgatcgatgccgcgctgaccgtcacgtcgccgttaccggtaatcgcacccatgcccgacacaccgccggcatgactgttcgcgatctggttgtcgccttgcaccgtcatcttgccagcaccgaggtcgacaatggcgccgtccgcgttgtcgatagaagccgattgaatgtcgagtgtgctggtgtcaccagcagtagattgtccggcctggacgtggccaccttggttcgacaaggcaccgccgctcttcaacgacagcgacgcgtccgatcgcagcaggccctgcgcgttgttcacatcgcctgcgatcgtcgcattgatgccgcgttgcgcggcgaggataccgctcgcgttgttccaggcggccgcgttgacgatggcttgtcccttcgtcacgatggtgcccgacgtgttgttcagcgcgctcgagccattgcccggtgcgatcgtcagcgtgcccgtgccggcatgtgtgatgttgccacctgcgttgttcagctcggcgggcttgagcgtcagatccgtgctgttggtctggatcacgccagcggccgagttgtcgagcgtgccgctgacattcatgcccatcgttgacgacccatactgcgtaatcgtgccgccgtggttgacgaggttttctgccgtgagcgcaatctgattggcctcgagcttgccgccgctgttgtcgagcgtcgagtcggccgtgatcgacaggttcggcgcgacgatcgaaccgttctggttcgtcatcgagcctgagtggattgccgcgttcgtgcccgcaccgatctggccgccatcgttcgtcagcatgccactggtgacgctcagatccgtattcgacaacagcttgccgctcgcattgttcagcgtgccggcaacggttgccgtcagtccgctctgcgcgttgatcgagcccgccgcgttgtttagcgcgccggtttgggcggcgacgcgtccgttgctcgcgatcgaaccgcctacgttcgatatcgagcccgagccgcctccgagcgtcagtgtgccgttgccggcatgcgtgatcgtgccgccgtcattcacgagtgcggtggggtgagcgccaggtcggtgctgttggtttgcagcgtgccggcattcgagttgtcgaacgtgcccgacacgttcacggccatcgcgccagcgcccgtctgcgtgatcgtgccgccatggttcacgaggtcggtcgcattcaacgacacctggttggcctgtacggcacccgcgctattgtcgagggtcgtgcccgtcagcgcggccgtcagaccgacgatcgagccgccgttgttgaccaggcgcacgcctgcgtcgacaaccacctttgcgcggcctgcagcgtgccgctgccgttgtcgaccgactggcccgatacccgcagattcgtattggaggtgatcacgccgcgattgacaacgtttgcgccttggaccgacacatcgccgttgccgccgataacgccgccgtgcgcgccgttcgcggtcgtgcccgccgcattggtcagttgaccggtggtcatcaccgacaggccgtcgccgttaagcgacgtgatccggccggccgtgttgtccagcgacgcgccggccaccgtcatcccggccgcgctttgaacggtgccctggttgtttgcgatggcgccaccacgcacctccgccgtactttcggacaccatctcgccagaccggttggcgatctggccggccacgttgaccgacagcgggccttgcgacgagaccttgccgccttggttcgacaggttgccgccggtcagcgtcgtgctgccgccactcgacaagctgccgtgatcgttgatcaccgtgccggaagcattcgcctgaatggcgccttgtgcgctcgtcgtcgcatttgcgagattcacgtcgccggccgtcgcgttcagcgacagattgccgtttgcggccgtctggctgccggcgagattcacgctgccgcccgtcagcgacgcgttaccgcccgccacattctggccggtcgcggtgagctggcccgacgccgtcagattcaggtcgccgctgtgcgcgacggaaccgtcgttgttcacacccgcgccgagcgtgccggtcgaattgacgctgccgacgttcacggtcgtgttctgctgcgcagcgaacgtgccgctattcgtgaggtcggcgcttgtgctggccgatagcgattgctgcgcgtacgtcgtgccgttgttctgaatgccgccggccgccgacagcgcgaggttgccactcgcggtcgtcttgcccgtcagcacaagtcggccgttcgactgcaatgtgagatcacccgcctgcgcagcgatcgtaccggcgttggccaccccacgccgaattcattcgatgcgaggaagatcctattgctatacattccgcccaactggctcacgtcgatcgcgaccgccggagcagggccgtcgccggcgatcggcgtcgcggcaagcgtgtcgtggttgacttgggccgccccggcgatcacgttcaggttcttcgcatagaccgctgcattcacctgtacggcacgggcgataaggtcaacctgatcggtaccggttgcgttcaggccggcgcctgacacggttacgagcccgcggttaacgttataaccggcgagtgaaccgtcggcgccgtagtacggcacgccggtcgtcaaggttgcgcggctggtattcaggaaggttccaccgtccacgaaaatcccggacgggttagcgatgaccagctcggcgcgagcgcctgcgatctccaaagcgccccgaatttgagaggggttcgggctgttgacttggttgacgatgatccgcgcggcctggcctgcgccgtaattcgggttgccgttgatccagcccgcctgctgggtctgaaccatcgtggccgagttgttcaggatcgcgccagcgcgctgtacgtcgaactggttgtaggtgttgaccgatacgccggcgcccgaaggcttggccacgttgacctgaggcaagccgttcggcgtctggatcacctgcgtgctggtgccgggcgtcggaacgatctgcgcaccggacagggtgggtagcatgccgagcgcggcgacgcccgccatcacaacgcgaacgccggacgtcgacgagcgccgccgcacacgtgcctcgcccgtcgctgatttcccgtcagccgtcgccgtctccgcgacgaccaccaccataccccgaagcctggaatacaccaggcgatgcgtattcttgttcattctcgttgacgcggcccgcgtccattcgttggttatcgaacgcgaccttaccgaaaccccgagaaatgactgtcaacaattgccaagtcgttgatggaaaaccacaaattctgcttttcggatgcgtctgattgacgaatgcagccctcatctaattgtggccaagacagcttatctcgttgatccgattggatagccatcgatatccgacgcgagctgcccgcccagtaaggctcaacgccatattcgacagagaaacagagcgccgggcggtatcagccagactgcaatcgtccaccaccatgtctctgcagagtttcgactttgctttgcgccatcaacaagatcgaaattcagttcgcatccccgaaaagtaaagtcagactctcggacaggtcgtcttgcggaatcatcgggctttcattgggggcacatgtcaggactttactttgtgggatgcctggcggggcttcgactcacacaggcggcgttcgagacagcggaattccacaaacgtttttgccggaagcatgctcgactgcacaccgtcggcagcaacgctgccggacatcgcatcgaagcgcttcggccgcacgcgcgtgctggatgccgtccgcttcacgcgttccgcccggcggcagacggcacgccacgatgcgctcatcgcgcgaatgcgctgcatgtcgcgccgcatggacagaaatgacaagcggttgaaaaatcgtccgccggccgcgagccgatcgcgtccagccgtgcagcgtcacgtccgtcaggattccggcgaaggctccgccggctcgcggtcgcgatcgccatccggattaccgtccccggcggccacccgcttcgccatgtcgaggtaggtctgcgccatcgcgcgcaactcctcctccgacgcgtcctcgatcccgatcagccggtcgctcgccgcgtgcgtgacggccacgagttcgtcgagcttcaggtgcatcgcgacactgtcgcggttctggtttcgctgcagcaggaacaccatcaggaacgtgacgatcgtcgtcccggtattgatgacgagctgccacgcatccgaatagtggaagagcgggccggtgacgagccacagcgccgtgatggcgaccgcgctgccgaacgcgaccggcgaaccggcccacacggtcacgtgcgacgcgaagcgttcgaacgcgcgcgtgacggggtgcctgaccgtgacggcccggggatcggtcgtggcccggccgcccgggcccgtcctggcgcgggatggatcgttcgattcacgcatggcgcctcccggatacgaatgtcgatatcggcgcacgcgcgggcccgccgtgcgcaacggcacgcgattccgcgcccgcaggcgggcgccgcccacagccgagcaacgtgcgtgcccgacggtcgcgcccgcgcgtcgccatcggtggtcaggtgtacgcagcgcgtgaggcaatcgtgcggcgccggtgtcggagcaggaggtgtcgcggttgcgcaaggctatccgacggtagcgcgaaggcaatctcccgcggcgatacggcgggccgcacgccacccggcaggtaatattttgtaatgatatgtagagcaatctttaccggttttgctctggcgagcgtgcgcgatacccgcatgcgcggcgctttcgcaaacgtttcctcacgaacgacattccgcccggtatttcagccggttgcacgccggataccgctccgaacgtgttgacgcgtacatcgcgtcgctcgactaaacacgacgccgcatcttcgtgcgttcgccttgctgcaacgcggcgacgccccgcccgcggcgaggctcaccgaacgatgcagatttcgccacattctgccggaatgtttctcagtatcatgcgcgtctcttcggcttccccatgttcggacgggcctgagcgctcgccactttcccgtttcgccccctcgtttagcgatgcccatccgaatcctgctcgtcgaagacgacgtcccattgtcctcgctgatcgcagactatctgcgcatgcatcagtacgaggtggacacgctgttcgacggcaccgacgccgtgtccacgatcgtcgcgcgccgccccgacctggtgctgctcgacatcaacctgcctggcaaggacggcttcgagatctgccgcgacgcacgcatgcagtacgacggcatcgtcatcatgatgacggcccgcaacgagcagttcgacgagttgctcggcctggaattcggcgcggacgactttctccgcaagccggtcgagccgcgcatcctgctcgcgcggatcaaggcccacctgcgacggatgcgcctgcgcccggtcgacggcgcaccggcatcgccgcagcgattcgagttcggcaagttttcgatcgaccgcgcggatcgcaagattcgccttcccgacggcagcgcgccgcgcctgacctcgaccgaattcgacctgctgtgggccctcgtctgccgcgccggcgaggtggtcagccgggaagacctgacgcagctgttacgcggaatcgagttcgacggcttcgaccgctcgatcgacggccgcatctccaagctgcgccgcaagctgtgcgacgacctgacggaaccgaagcgcatcaagacgatccgctgcaagggctatcagttcagcaagcacgcatgggagtgacgtgccgcctgtcgtggcatgcgagcgcacgaacgggtgccctgaccgcccgccgccctaccgcatgttgccggtatggcccagcgaatagcgccccggctgcggccacaccgtcaggccgtgcggctccatcccgacgggaatcgctcgaaccgcgccgctcgtggtgtcgatcgcgtagacgacgtcatcgaagcggcccgacagccacagcgtcttgccgtccgcgctgacgttgcccatgtcggggctgccgccgccgggaatcggccagttcgcgaccaccttgcgcgtcgcgaagtcgagcaccgatacgctgcccttgccgtggcgcggcccgtggacgagattggagccgcgattcgcgatatagagcttcgtgccgtcgcggctcggatacagcccgtgcgtaccgacgccggtcgggatgaaaccggtcttcgcgaagcgctcgccgtcgacgacgtatatgccgtccgccatcatgtcggcgacatagaacaccttgccgtccggcgccacgcggatgtcctgcggcatccctttccggtcgagttcgaggtaaccgagcaccttgcgattcaccaggtcgatcttcgcgagcttgccgccgaactcgcacgtgaagagcgcataccggccgtcgatcgaaaagtccgcatggttgatgcccttgcattgcggcacctcgaggctcgatttcagcgccatcgtgcccggatcgtggaagtcgagccgcgcatgcgcctcggccacgacgatcgcatccttgccgtcgggcgtgaaatacatgttgtacgggtcgtcgacgcgcactgccgggccgggcttgcccgtcttcggatcgatcggcgtcaggctgccgtcggtgcgcccttccgcattgttggcgacccacagcgtccgcaggtcccacgccggcacgacgtgctgcgggctgcggccgacggcaaaccggtcgacgaccttgtacgtggccgggtcgatcacgtagacgtcgttcgatcgcaggttcggcacatagatgcgcggcagtgcgcccgccaccgccgcgctcatgcggccggcccgtgcctcgccgtacaggttgtcggggttgatcacgggcggcatgccgggtacggccgcgacggcggacgccgcgatcgcaccctgggcgcaaaagccggccagcgcagccgcgacgacgatcgcgggacggggaagcggatgtgacggcgaaggcgcggttgcatgacgatgtcccggttcgatggaatggaacgacggcaaaggcggcgcaatggcgcggcggcgtcagcggccggcggtgtcctttctgatcgcgtcgacggtgcgcgacacgatcgcgtcggtgccgagccggccgagttcgacgctcgcatgacgcggatcgccgccgtagacgccgtcggcggcgccgggcttcaaggcgttgcgcagcttgtcgaccctgaccatgcccggcgcgaccgccagcagcagcgacgtatcggccagccccgcgtgcgtgccgatgtccgcggccggcacgccgtgctcgcgcaggatccggtcgtaaccgtcggaactggtgccgtaatactcggccggcacgaacgcgcgcgcgcccgtgccggcccacgacttgttcagccgcgcgaccgactgccggatgtcgttctggtagccgccgtggtcgccgaggaacacgatgttcgtgaagccatggacccggaagctgttggctgcggactcgagggtcttttcgaagacgtcgtcgggcacggtgatcgtgccgggaaagcgcatgtgcgacgtcggcggcgcataaccgccctcgggcacataggcgatgacgggggcgacgattgcgttgccgaggctttgcgcgatccgctcggacagcaccgcgacccgcgcattgtgcttgcccagcgcgacgtacggcccgctttgctcggttgcgccgaccggaatcaggatggtggtcttgccggcccggacgctgtcgcgcagctcggtccaggtcatgtcttcgagccgcaccgtggcgggcacctcggcgaacgcggcttgcgcgacggtgaaagcgagggcggcgaaggcggcgcgtggcaggcatttcatcgcggattctcgacggaaggaaagagatgacgctgcgttccctcgcaccataaacgaactcgcgcgacttgtcgccgaccgcggcgcaacgacgcacggcccgacgtcgcgagaaagcatttcgtcaggattgaccggcagatcgcgaggtctctcgttccgtgccggcacgcggcgagtcgggtcgattcgatgcgtgcgctacgtcgcctcgtgccggcctcccgcccgcacgcgtcacgccggcaacacggccaccgccttgatctcgacgatatagcccggcgcgccgcccagcatgtgcgcgccgaccgccgtccatgccggcttcgggtgcgcatcgaggtagcggtcgcgcacctgcatgaacaacggcaggtcgcgcatgtcggtatggaaggtcgtcaggtcgaccacgtcgctgaacgatgcacccgccgcgtccagtacccgcttcagattctcgaatgcctgcacgatctgtgcttcacgatcctcgacgagctgcatcgccgcatcgcggccgatctggccggatacgtacagcgtatcgccgaccttcaggccgggcgcatagccgatcttctcgtacaccgcttccattcccgccggaacgatggctttgcgatcacgcatggaagtctccatggccggcgtcttcgcgccggccggttggtgggtggataggtggatgggttgtcgacgaacatcctgaacacgtgccaggctgcgcgacgacgcgcggctcaacccgtatcgccgcccgcgaccggcagcaccgtgccggtgatgtagctcgcctcgtcggatgcgaggaacaggatcggcgcgatctgctcgtcgaggctgccgtagcgtttgagatacgtcgattccgtgacctggcgcacggcttcgcccatccatccctgttcctgttcgctgtcgccggccgcattgcgcggcacgcggcgcggcggtgcgctggtgccgcccggcgcggtggccacgacccggatgttgtgttccgcatattccatcgcgagcgccgacgtcagggcattgacaccgcctttcgccgccgagtacggcacccggcgaatcccgcgcgtcgcgttcgacgagatgttgacgatcgtgccgccgccgcgcgcgagcaggtgcggcagcaccgcgtgacacgtgtagagcgtcggcatcagcgaacggcggatttccgcgtcgatctgcgcgggttcgaattcggcgaacgggcgcatgcggatcgcgccgccaacgccgttgatcaggatgtcgatgccgccgaacgtctgcaccgcgtgcgcgatcgccgcatgcgccccttcgtacatttcgagatcggcgacgaacccggccgtctcgccacccgtcgcttcggccgcgacctcggcgacgaaatccgcgcgatcgacgaacagcaccctgccgccttcggccgccgcgcgcagcgcgacgccgcggccgatgccctgcgcggcacccgtgacgacgatgaccttgcctgagaatcgttgcatgatcatgccgcctttgccgtgacgttggggtgaacttctcgtagtggaagctgttcggcttcacgccctcgtcgtcgaaatacttgcgcactgcgtcaaccatcggcggcggcccgcacagatacacgtcgacgtcgccgtcgttcagcgcatcggccgggatgtgctgggtgacccagcccttgcgcggatggctcgacgccgcgtcggccacgaccgtcgcgaagctgaagttcggcagcttcgccgcatacgcctcgatcgcatcgacgagcacgaggtcgagatcgcgcgtcacgccgtagatcaggtgcaccttctgctgcgagccgctgcgcgcgagcacctcgagcatcgacaggaacggcgcgagccccgtgccgcccgcgaggaacagcagcggccgctgcacgtcgcgcaggtagaagctgccgagcggcccgtgcagttcgagcgtgtcgccgggccgcgccgattcgagccacgtgctcatcacgccgccggggatcttcttgatcaggaaactcaccttcgcatcggccggcgccgacgagaacgaatacgaacggtgctggccactcgccggcacgtcgatgttcacgtactggcccggcaggaacacgggcgcggccgtgccgacgtcgagttcgagcacgacggccgcatcgttgtgctgctcgaccttcgtcaccgtggccgcgaacccgctctggcccgtcttgcacgcgaccgacgacgtcggcaccgcgatcacgcaatcgctttgcggcaccatctggcaggtcagcacgaggccgccatccttttcgtcttcggtgagcgcgtcgtcgatgtagtcgtcgccgagatcgtagcggccgctttcggcgcggcacttgcaggtgccgcacacgccgtcggagcaatccatcggcaggttgatcttcgcgcggaaggccgcgtcgagaaccttctcgccggccttgcagtcgatgaagcgggttaccccgtcctcgaagttcagtgcaatcttgtagctggacatggtgtcacctccacttcctttcatgacaaaacaacggcgtcagacgtgatagacgtcgagcacctgccggatgtagtcgttcttcagcacgatcttcttgtacgagatcagcagctcatcgcccgccttgcgcaacgtgacgaacatcgtgccgaagaagtgatcggtcacgcggtagcggtggttcagcgtgtgaaagttgtagcgcacgtccacttcgttctcgcgttcggccagcacctcgacgttcgtcacgttgtggctggtgcgcggctcgggcgtcgatgcgccgctgcgctcggtcttgatccggaacacgcgatcctcgaggccgccgcggtccgcgtaatacatcagcgagatctggctttgcggatcgtcggtcggccggtcgtcgtcgtcccacgcgggcatccagtacgtgacgtcctccgtgtagcaggtcagccactcgtcccactggcgatcgtcgagcaggcgcgcttcgcgatacagcgcggcgcagacagtccggtaatcgaagctcatgctgccacctcccgcgttccttcttcagcgcatcgcgcatcacgttcacccaatgttcgtgctggcacacgaacagcccttcgtcctcgctgcgctcgccggaaatgcgcgggttcagccccatcttcctcgcgttctcgtccgggccgtcgacccacagcggcgcgccgcgcgacaggtcgttccacatcgccgtgatgcccgcataaccggcctggcacgcgcgaaactcctcgagatcgtcggcggtgcccatgcccgtcacgttgaagaaatcctcgtactggcggatgcgggtcgtgcggtcggcctcgctctcgcccttcggcgcgaagcagaagatgctgacctcggtcttgtcgacgccgagcggccgcaccacgcggatctgcgtgctgaactggtccatcaggaacacgttcgggtacacgcacaggttgcgcgtctggttgacgatgaagtcggcctgcacgtcgccgacgcgcgccttgatttcatcgcgatgctggtacacgggccgcacttccgggttcatcgtctgcgtccacagcaggatgtggccgttgtcgaagccgtacacgccggcgaccgacttgctccagctgttcgcgtcgacggccttggtgccgtcttccttgcggcggcccatcgtcgccgcgtagttccagtgcacggtactgacgtggtagccgtcgcagccgttctccatctgcatcttccagttgccttcgtagatgtaggacgagttgccgcgcagcacctcgagcccgttcggcgcctggtcgacgatctggtcgatgatcacgcgcgcctcgccgaggtagtcctcgagcggcagcacgtcggcgccgaggctgccgaacaggaagccgcgatagttcgcgaagcgcgccaccttcttcaggtcgtgcgaaccgtgcgtgttgaactgcaccgggtattccgtcgtcttctcgtccttcaccttcagcagcttgccggtgttcgagaaggtccagccgtggaacgggcacgtgaagctgcccttgttgccgtgcttgcggcggcacagcatcgcgcccttgtgcgcgcaggcattgatgaccgcgtgcagctcgccggtcttgtcgcgcgtgatcacgatcggctggcggccgatccacgtcgtgtagtaatcgttgttgtcgggaatctggctttcgtgcgccaggtacacccagttgctttcgaagatgtgcttcatctccagctcgtacagctcggcgttcgtgaagatgtcgcggcggcagcggaatacgccggcctccttgtcgtcctgcacggcggtggcgagcaggtgatccaggtcggtggcttggtcgatcgtggcggacatgatggctcctcccatgcgcgtgccgcgtcctgcaagcacgctcgcatcggtaatcggttgaatctcgcgggaacccggccggcggcggcgcctgcgcgccgccgtgccgtcgggcggttaggccgtggcggaagcgcgcaggcgttcgacgatctggttgtccttgccctcgacgcgcggcgtcaggacgaagttgaactcgatgtcctggtacgcgtcggccttcaggccgagcgcggcgccgccggtcttgccggtgacgggcgggatcagctcgcgggtcgcatacgcgaagtcatcccagatcagcgggtcgccgtcgatgttgaactgggtcgtcagcttgcggtggccgtcgctggtcacgaagaagtgcacgtgcgccgggcggttgccgtggcggccgaggctgtccagcgctgctgcgtcgcgccctgcggcgggcagccgtagccgaccggcatcagcgtgcggaattcgtacttgccgtccgcgcccgtcttcaccgcgccgcgcaggttgaagtcgctctgcttgccggtcgggtcgaagtgcgagtagaagccgtgcgagttcgcatgccagcactcgaccaccgcgccggccaccggcttgccgtcgacaccggtgaccgtgccgtggatcacgagcgggcctgcgccgtcgtccgcatcgaggtcgatcttcgcgacgccgtcgcgcaccggcgcgcccgcgacatacagcggcccctcgatcgtgcgcggcgtgccgccgtcgaggccgagcgcttcgtcttcggcgtccatccggatgtcgagaaacttctcgaggccgaggccggccgcgagcagcgccgcttcgccgtcctggccgagcttgttcaggtagttcacgccggcccacacttcgtcgggcgtgatgtcgagatcgtcgatcgccttgaacaggtcgccgagcagccgcagcacgacctgctgcgtgcgcgcgttgccgcccttcgggctgtccgcgcccgcgttcgacgcggctttcagcagatcctgcacttcccgggtttcgaaaactttgacgctcatgatgatgtctccacgtgtatttggggaatgacggcggtgcgtgactcgggttaccgcgcgacgcgggtgagtccgtcgcgggtgaaacgcctgaccttgtcctcgtcgagttcgatgccgagaccggggccgtccggcacggtcagttcgaagtcgctgtaatcgagcggctgcgtcaggatctcttcggtgatcagcagcggcccgaacagttcggtgccccactgcaggttcgcaaaactcgcgaacaggtgcgcggacgccaccgtgctgaacgcgccttcgagcatcgtgccgccgtacagctcgatgccggccgcgtccgcgatcgcggccacgcgctgcgcggcgaacaggccgccgctctgttcgatcttgatcgcgaacacgtccgcgccgtgatgcttcgcgatctcgaacgcgctgtcggggccctgcaggatttcgtcggccatcagcgcgaccgggaagcggcgcatcaggcgcgccagcgccgcggccgaggccaccggctgctcgaccagttcgcagccggcatcggccagcgccggaatcgcgcgcgcggcctgcgtttcgctccacgccatgttcacgtcgacgcgcaccgatgcgcgatcgccgacggccttcttgatctcggccacgtgccggatgtccgtctcgggcgccttcgcgccgatcttcagcttgaacacgttgtggcggcgctggtcgagcatgcgctcggcttcggcgatgtcggtggccgtgtcgcccgacgcgagcgtccacgcgaccggcaggcgatcgcgccggcgcccgccgagcagctcgctcaccggcaagccgagccgcttgccgtgcgcgtcgagcagcgcggtttcgagcgcgcttttcgcgaagtgattgaccttcgcgagcttgccgaggaacgccatcagcgtctggacgcgcgtcgcatccttgccgacgatcgccggtgcgaggtacgcgtcgatcgcgagcttcatcgcttcggggctttccgggccgtaggccatgccggcgatcgtcgtgccttcgccgaggcccgtcacaccgtcgctgcagaacaccttcacgagcatcagcgtctggccgtgcatcgtggccaccgacagcttgtgcgggcggatcgtcggcaggtcgacgaggcgggtttcgatacgttcgatggtgacggaggacatggggcacgccgtgggggtgaagttcttgaggcgatttatacgtcccggccagatggagcgtccaatacttttaggcgggatttttgatacctggcaggtattgaattcacgctcatcacgctaaatactgcggtgcgccatacctgttttggctaggtatgcgggctgagaggcttgatgggtcgcggtcgtgcgggtgtggggtaccgtctggatgggggcgcactgcggcggcttgcggcagcgggaaaacggcctgaaaccgacggcctgccgagtcgatcagggttttcctgacgggaaaaatggtggggctggccgtccggccttcagctttggcgtcggtttccgcgaacaaccggaaggaatcgggcaggtgggtatcgacgttcgttgtcgatgttcgttgttcatcagaagctgacgggcgctgtcggccatttccagacgttcgaccaattgacctaggtcgttgccaatatccttgacgcattccaagtgtgatgttttcgggccacgcaaatttatttattccctagcagtgtcgggagcaatccaggggaggaagatcacctatgttcagcgaccaccgttccgtcggacggcggtcgggtgtagcgtcgccaatagttctcgaagatagaggcataatccaagaacctcgcggaacaacagccgttcggctcatgtcgggtgttgagacgaagcagtctatgtaagaccggcttcggggtgtttgtgcaacggcaaggtcaaagaaatgaaagtacgaaaaatcagactccagaatggatataagcgattccacgatctcaccatcgatcttggagattctccagccaaaattatcgccctagtcggcctgaacggaagcggcaagagtagtgtacttgatggtctattatttcatcataatatatggagcactattggaaatactgggcgcaaagattttaagtatcattcgatgagggaagatccgggtttcgattacaataatgtgacaatcgaattcagcgaaggcgattaccaatccgcgcgacagcggcggaaaggagagaaaatacaatcttttcgtttcgaagtccatatcgctacaacagtgatttggacgtcaaaaatgtagaggccgttgaagacattatcaaaaacaactacggcgcatcggtgacctctgccatcgatagtaaaatgttagttaactatcgacgtttaaatgttaggtatactgcctacatgtatgaggtggattgcaagcccagtgaggcacgacaaaaattattggcgacttaaatgagtctttaaagaagtgtttaaatctcgagatagacaatctgggggatattgagagcggtaaaggaactttgtttttcaagaaaccggatcatccgaacagcttcccattcaacgttttatcctcgggtgaaaaggaagtggtggaccttctgttagatctatatctccgctcagaagagtacaccgatactgtatttttactcgacgagccggagttgcacatcaatacgtcgatccagaaaaacctgttattggagatgaatcgactaatcggggacaattgtcagctatggatcgcgactcatagtattggatttctgagagcgctacaggagaacctgcgggatgattgtcagttgatctatttcgatgatacttacaacctcgcggctaagccgtacacgttgaaaccttcgccaaaaattcaaatacttggaggaagattttcggtgtggcgctcgacgatttggcgcatctgataagtcctcagagaatagtttattgcgaagggcgcgatacacccggtgaaaacggcaaagagagaggcatggatgcaaacgcctacaacaatatttttaacaaaaatatcctgacacattgttcgtttccagcggtggaaataccgaactggaccaaagaagtgcagtagcgatatctatattgtcgaaagcaatcccctccgttgaaattttcgtactcaaggatagagactctggatctggagcgctagtttccagcgacgaaagagatttatatttaagaaataatccagaaaaccatcgcatgctggatagatgggaaattgaaaattatttatttgacaaagaagttttattggagtattgcaaaaaaatgatttgaagtttgatgaacaagcttacgattcatttgtcacagatatagaaaaccaagacgttaaagcgatggcatcaaaaattcgaagcatctgcaacattaagacgaacatcaatgcagaagtatttaagcttcgtcttgcggaggtctttaacgaagatatgcaggtttatagacagcttgagtcgtgcatatttcacgcaaagatctgttagggcaatcaccggccagcagtagtggtatgtggtgggggcagcgttgactgagaactgcgctattgtcgactgtcggctatcgagaaagttgagaggccaaaacgggtcgatttccgtcggttgctttcgattgtgagggcacgtatcgggccgtgcgagcgtacctggacaaccaagcggcgtaaaaacaacggggccggtggccctgcctctcaaacaatgcaccggcctgcgtatcagtttctacgcaacagccagtttcgcgcgctccgcaacgaaactcagccgatcgaagttcatgtttgcgccggacgtgatcgcgatgagcgtttcgttctcgatcccttcgcactcggcgtacagctttgcccctgcgacggccagggcaccggccggttcgagcacgctccgcgtatcctggaacacatccctcatcgccgcgcacaggccatcggtatcgaccgtcaccacgtcgtcgaggtgttcgcggcataaccggaaagtctcttgtccaaccagtttgaccgccgtaccgtccgagaacaaaccgacctccaccagttcgacgcgttcacccgcacggagcgactgcgccatcgcgcatgaatcctccgtctgcacgccgatcaccttgatgcccggtcgcacggctttcacgtaggtcgccacgccggacgccaggctgccgccgccgatcggcacgaagatcgcatggatcggcttttgatgctggcgcaagatttccatcgccaccgtgccttggccggcgatcacgtcggggtcgtcgaacggatgcacgaacgtcaggttccgctccttctgcaacgtgagcgcgtgcgcgtaggcgtcgctgtacgactccccggcctgaatgacctcgacacgcgaaccaccatgcctgcgcacggcatccaccttgacctggggcgtcgtgagcggcaccacgatcacggcgtgcacgcccatgcgagccgcgcagaacgcaacgccctgtgcgtggttgccggccgacgcggtgatgacaccgcaagccagcgcatcagccggcatctgcgccatcttgttgtacgcaccacgcaacttgaacgagaacaccggctgcttgtcctcgcgcttcagatggatcgcgttgcgacaccgaaccgacaggttgtgcgcgaaatccagatcggtttcgatcgcgacgtcgtagacgcgcgcggtcaggattttttgaggtaatcgaacggcgccgaaggatgggcggggctctgtacgtgcgcgtcgaatgggtttcggtgcatgaacacgatgatttcctttccaggtcagggtgggcaagcctagaagcggaaatgaaaacccgcctcggcggcgggttttcgttatcgagcaagtacgcgctaacccaccattcggagaatggtgcgaataatcagcgcgatggcgatggctcgatgttccatggacacaaggattgacgattatgggaatgctgtcaaccagcggcgcctacgctgaaagccagtcgcatcacgtcgggcggcggcgcgtccggcggtgtacgttttcttcggtgccgcttgcgcatcctgtcgtggggcagtttcaacgtgtgaggtcaagcgcccggcggctttgggtgaagcgaacgccttggccgggctggccggtttcaaggcagcaaccacgcgtgcctgcacatcacgctcacccaccaggctggacacgtgctggcgcgggtgctcaatcgcggcgggtggcggtcggcccggaatggccatcgaggcgataccagaccgcccagctgagttgggtcggtatgcgctggtcaccagaggcagttgccggccaatcgcagacattggactaacctgtacggatcgtcgacaatggtgacgcgtagggccttcagttcacaagttagtccaatttcccgttccgcatatgcttgacttcaaagagttagcccaagatgggcaagacttcgagcttctcattcgcgaaatcctttttagagagggctttcacgtcgcatggagtggtcgggggcagacggaggtcgtgatttggtgtgcacagaaaaccgacagacgattcttggcgcggagaccaaaaatggctcgttcaatgtaagcattttgcccactctgaaagatcggttggcgttgcagacctcgatgacattatcacttcggcggcgcagcacaaatgttccggctacctgcttgcctgctccaccttcccgtcatcaggggtagttcaacgcctggaagccatcgttgccaatccggagatgcggctgtcaactaactattgggatgcggtgcagattgagaggctactggcaacacctcggatgtggcgcattgcgcaacgctttttcctacgacagcgactgggttcgaaatctacgcaactgagagcccaaatcgatggattgtcaactacaggggctattacttctacctgtcgaacagagtcggatctcgagcggatgtgcaccttgaaagcatcgccgccagggttgctgaaatcgaggcaattgatcttcctggcgatcaccatcttcgaatccgtgccgtctactatgacgacaaacacggcggatacacttggtatctggactatcttcgaccttaccgaaatctcgtgcccgtaagcatagcttccctgaaacggcgtctgaaagatggttggggcttcgaagatggccaaacataccacttcgatatcgtcgtgcgatcaacttcaccttccagcgatcattatgacgttgatcactacgactactacgaggacgatgcgcacgctttcagttggggattgaccgacgtccgtctgatatcgaatttaccctttccgcaacggagcaagatgcaatcgccgcgaaagcccttcaagaggactcgttcaacgcaatgctggaggcgttttctcacctcagttttctcaatataatccgggcggaaaattgctccgtcgaggcgatacgagactttggtacaaagtgggattggaaagaattgattgatgctggcgcttccacggaccgtttcttttccgtctggattttctttcgcgttactgatcccgccaagtttaacgagtttatgactacgctgccgcaagacttcgagcccactttccgattgacgcagccagtgatatacctaccggccgctgatggtgagggaagcgagctgtcgagcgataacgatgagcacgcttacgagctgacgctgcgcgtggggcctctcggcgcgccggacatgttcacgacccgcgaccgcctaaacgcatacatggatcgaatcgctgcggcggcaaggaaatttgcggcgtagcaaagcttcgcggtctttcatcggtcgaatgaccgctttctaagattctgaatggctgaatcgggtggtggattcaagcggccgttcgacacagcttttagatcgtcggcaatcggtgcagataagggcgtagcctttagcggttaccgtcgatcagatcgttcagcagcgcatcgaacgcggcctgtgcgtcttcaagttcctgcagggcggcatcaaaggtttgcagcgcgaacggcgaaggctcgccgctgccttgcggcggaaattgcttctgcatcgaggcgaacgtactctgcacgcgcagcgtggcggccaccatgcgctccatcgcctgggtttcttcggctcgggcctgttccggattcattcctctctccttggatggttttcttgaagaccagatcgtacacgctgtgtccgttcttgccgcccttggcagaacgactccgttgaaggttccaacggcacgctgcgggagaagcgatttaatcgggaatgattccgcagtcgcgccgaggccaagatactcatcgggcgtggctacaaaatcccgccgcaggtcacccagacggcgtgcggcaacaatccgcacaacgactgttcagtttccgcacacaaattcgcagatgcccccattccacgcgccctccgcaggtgggaagaaacccggatagccccgcttcgccgcgcccgcctaccctcgcgcgcatgccggtcgggacgatgcaaggcccgatccggcgggtcggaatttcctcaggagcgtacatggatagcagcagcaacacggcactgttcgacgccgacatctggcacggcaagactttcaacggacgctggcacgccagcccgcacgcggccgacgtgatcgaacccgcgaccggcaacacgctcggctgcctcggcctcgcggatggcgcagcggtggccgaagcgtcggccgccgcacatcgcgcacagcccgcatggttcgcgctgccgtacgacgagcgcgcggccgtcctgcgccgcgcggccaccgtcgcggaaactcacttcgatgcgatcgtcgactggctcgtgcgcgaaagcggctcgacgcgcgcgaaggcgtcgttcgaaacgtcggtcacgatcaaggcgctgcacgaagcagccgggctgccgtcgcgcgcggccggcgaagtgcttccgtcgacggccggccggctgtcgctcgcgcgccgccgccctcgaggcgtggtcggggtgatctcgccgttcaacttcccgctgtacctcgcgatgcgcgcggtcgcgcccgcgctcgcgctcggtaacgcggtcgtgctgaagcccgatccgcgtaccgccgtgtgcggcggcgtcgcgatcgcccgcgtgttcgagctcgccggcctgccggaaggcgtgctgcacgtgctgcccggcgacggcgcggccggcgccgcactggttgccgatccgcacatcgcgatgatccagttcaccggttccaccgcggcggggcgcaaggtcggcgaagcggccggccgccacctgaagaaggtctcgctcgaactcggcggcaagaactcgctgatcgtgctcgacgacgccgatctcgaccgcgccgtcgccaataccgcgtgggggcgtatctgcatcaaggccagatctgcatggcgaccggccgcgtgctcgtgcagcgcggcattcacgaccgcttcgtcgcgaagctcgtcgagaaggcgcaaagcctgcgcgtcggcgatcccgcgagtgcggacgtcggcctcgggccgctgatcaatgccgcacagctcgaccatgcggcgagcctggtggacgcggcccgtcgcgcaggcgcgcgcgtcgagacgggcggcggccaccgcgacctgttcttcgagccgaccgtgctgagcggcgtcgcgccgggcaacccggcgttcgacgaggagatcttcgggccggtcgcggtcgtcgtgtcgttcgatacggacgaggacgccatcgcgctcgcgaaccgcaccgaatacgggctgtcgacggcgatcctgtccgccgacgtcggccgggcactccggatcggcgagcgcctgaacaccgggctgctgcacatcaacgaccagacggtcaacgacgaagtgatcaacccgttcggcggcgtcggcgcatcgggcaacggctcgagcatcggcggcgcggcaaactgggaggagttcacgcagtggcagtggctgacgatcaagggtgaagcgccgctgtatccgatttgacaaggagaccgaacatgtacaccgaaaacgattcacgagccgtcaccgcggccgtcgcgcgcgcggccggcgcgcccttctcgatcgaatccgcccgcctgcgcgcgccgcgggcgacgaggtgcgggtacgcgtcgtcgcgacgggcctgtgccacaccgacctgatcgtgcgcgaccagtactacccggtaccgctgccggccgtgctcggtcacgagggcgccggcgtggtcgaggcggtcggcccgaacgtgaagacgctcgccgtgggcgatcacgtggtgctcacctacggcgcgtgcggccactgcccgtcctgtgtcggcggccacggcgcgtattgccggcagttcttcgggctgaatttcggcggcgccgacgccgacggacagaccgcgatccgcgacgaacacgggcagccgctgcacgatcatttcttcgcgcagtcttcgttcgccagctatgcgctcgcgcgcgagaacaacgcgatcaaggtgccgccggaagccccgctcgaactgctcgggccgctcggctgcgggatccagaccggcgccggcgcggtgatcaactcactcgccgtacgtgccggcagcagcttcgcaagcttcggcgcgggcgcggtcggcatgagcgccgtgatggccgcgcgcgtcgccggcgcgacgaccatcatcgcggtcgacatcgtgccgtcgcggctcgcgctggcgctggagctgggcgcgacgcatacgatcaacagcaaggaagtcgatgtcgtcgacgcgatccgccagatcaccggcggcggggtcgactacgcgctcgaatcgaccgggctgcccgccgtgctgtcgcagggaatcgaagcgctcggctcgcgcggcacgataggcgtggtcggcgcgccgaagctcgggacgaaggcggaattcgacgtcaacaacctgctgctcggcggccgttcgatccgcggcatcgtcgaaggcgacagcgtgccgcagacgttcattccgcagctcgtccagctgcatctccagggcggtttccgttcgaccggctggtgaagttctatccgctcgaacagatcaaccaggccgcggaggacagcagcagcggcatcacgctcaagccgatcctgcgtttgccgcattgagcggcgacacgccccggtcgcggggtaaatcgcgaccggggtgcgcatgggtctcgcacggcggcgtagccgccgcgagaataccgcgccgcgggcgccgggctatattacgcattcgcgcgacacgcgggccggcacgtccggcccgaaccttcgacccaactggagcgcagcgtgaatacagccccgaatccctgcacggccggtcgacctcgaccggctccgcgcccgcttcgcggcgggcgaaccgctgccggaaacggcgttgccggctggcgtcgcgcgctcgtggctgcgttcgcgcgacgccgggctccggccgtggcaaaccgcccgctacgaaatgcagcgcgaactcgacgaatcgcgcgcggaccggcggctgacccgctgcgtcgcgcaggaaatcgagcagctgtgggccgcgttcggcggcagcgagtggacgatcttctgcgtcaatccgcgcggcacgatcgtccacgcgcggcgcagcccgcattgcgacgacacgctgctgacgccgatcgtcgccgggcgccggatcgtcgagccgaacatcggcacgaccgcgccgagctgcgtgattcacgacggcaccgaggcggtcgtcgcgggcgcccagcactatctcgacgaattctcgcgcgtgttctgtctcgcggtgccgctggtcggtttcgacggggaagtgatcggcgcgctggacatcaccggcgtcggccggcgcaatgtcgtgcagttgcgcgagcagttccggcatgcggcgctgtccgccgagcagcggctgtatgcgatgctgcgcgactgccatctgctgcaggtgcagtacgatccgcgctggctcggcacaccgctcgcgggcgtcgtcgcactcgacgcggcgggccgcgtgcgcgcggcgagccggctcgcgcggcagatgctcgagctcgcgcctgccgggccgatcgaaccacacgatctccggcaactctttcccggcgcgacgcccgcgcagcagcgtcgtttgctgacaccggcgcgtacgccgcagcggatcgcgcgcgacgacggcagccacatctgggtgcgggccgtgcgcgcaccgctcgaccgggcgacgatgcggcggcaatccgatgcgctggacgacgccgccgacgtgtgcggcaccgcaccggccgccagcccgcaggcaagcctgcacgagcagtcgctcgacgcgatccgccgtgcggtcgacgagcacgacggcaacgtgtcggccgccgcgcggcaactgggcatctcgcgcaccacgctgtacgcgaagctcaggcagctcgatgcggcgggaatcacgaacgccggcgcgcattgatactgcgtgcggcgatggcgcctgcgcccccgcccgcctctcgtgcggccgcgacgtgaaccacacgatcccgaccgcgccgcccccaccgcccaaggtgccgatccacggccgttcggcgtcacgggaatccgccggtcgtgcatgccgaagccggcttcgcggcgagcgccgccggcttcggcaattcggccgccgcccttccacctcccggcgcggcgacatggcatcagcccggataaccgcccaacctgccctcgaccccgaacccgtcgtccggcgccggcagtcgcccgagcacccgctcgacctccagcgcgaccgcgatgagttcgcgatcggtgccggccgcgccgtccagtgcgaggccgaccggcagcccgtccgccgtcaggccggccgggacggtcatgcccggcacgccggcgttgctgcccggctcggtgttgcggatgtaggtcgagaacaccgaagcggtttcgccgttgagcatcatcgtgtcgcccgccgggatggggcacgcggtggcgatcgtcgtgggaaagaccagcgcgtcggcgccgctgtcggcgaggcactgccgatacgcggcacgcgaacgcgtccgccggtcgagcgcggtgcggtaggccgcttcgccgatcccgtcggggccggtgacatggcgggcgatcctcgcgacgtccgggctccccacgttcgcgacgatgtcgtcgaccgacaggtcgtagccgttctcgaccaggtacgcgtgcatcgacgaacggaattcgtacatcgcgatgacggccggctcgtcgtcgaagaaccccggatagtcgttcaggtcgaggtcgacacattcgaatcccgcctgctccagcttcgcgaccgcggcattcgcgaccgcgtcgacgtccggcgcgaggccgcgccagaacgtcgtgcgcgggacggccaggcgcacggggcgcgacgcgctgcgtgccggcatcgacgtcggcgcgccggtgccggaaccggacaggatcgcgtcgagcagcgcgatgtcctcgaccgaccgcgcgatcgggccgacggtgtcgcgcgtgcgcgagatcggcgccacgccgcccgacgggtagcgccccacggtcggccgcaggccgacggcgccgcacaacgcggccggaatccggaccgagccgccggtgtccgttccgagcgcggcgggcaccacgcccgcgccgaccagcgcgcccgagccgctgctgctgccgcccggaatccggttgaaatcgtacgggttgcgtaccgcgcccgtgacgcggttgttgcccgacacgccgaatgccagctcgtgcaggttggccttgcccgcgatcaacgccccgtgcgcgagcagccgcgccacgaccggcgcgtgctgcggcggcacgcggttgtgcagcgccagcgtgccgttgccggtcggcaggcaggcggtgtcgatgttgtccttgatcgcgatcggcaggcccagcagcgcgtgcggggtggccgacgtcgcgaggtcgcggtcgcagcgggccgcttcggcgagcagccgcgcctcgtcgacgcacgtgaaaccgttcaggtagcgccagcgtgcgtgccgctcgatcagcgcgtacgcatactcgacacaggaaaacgtccggcgcaggatcgcgttccgggcttcggtgagcgtcagggtttccagggtggccatcgtcgtcgttcctcgtcacggggatcgctacaaggtagggtgtgccgattttgacggccatcatcacaatggatgaccccggccgacggccgcgccgccggtcacgccagcgcggcggccaggctcgcgcggttggcgacgcccttcttcgccatcacgcgccgcagatgcgtgcgaaccgtcgacagcccgatgccgagcgtgcgcgcgacgtccttgtcggtataaccggcggcgacgagccgcgcgacgtcgctctcgcgttcggtcagccccgcgcacgcgtggcgccgccgcagcagcgcgcgccggaaaaacggctcgatgccgttcagcagcagcttgtcgcgctcggtgaaatccggccgcccttgcgcgcgccagatgcgcaggtcgccgacgtgtgtcgcgccgtcgagtgcatagacgttgatgccgtgatgcatgccttcgcggcgcaggaaatcgttgtagaactcggttcgttccagctcgcgccggctcaccacctcgtcgacgcaggtcgccacgcggcgcgcgcgcagttgcggcgtaaccgggtcgatatgctggaaccacgcttcgtaccgtgcgatctgcagcggatcgacgttgtacgcgaacccgttgcgccacaggcccgtgtgttcgtcgcaatcgaacgacgcggcgaaatccgcgcggatcagctgcgtgatcgcgggcagcacgaccgtccgcacgtcgacgaccggccccagttcttccaggcgggcgacgatgtcgccgaacagccggagctcctccggcgtgatgtcggagacggacaggttcatgacgccgccgcgaccgacgcctgccataacgcggccacgccggcgtaatccctgaccttgaacgccgagccgtcgcggacgtgaacccagccgagcgtgcgctcggcgagcggcttgtcgtggtcgtccgtcgcgatcttgacgatcgcatgcgcgcggacatgcacgagaccgtccggatagtcggacgacgggttcgcgagcgtcaccgtcacgaacgggccgagctcctgaaggagccgggcggccggcggctggtcggccatcagcaacgcaccgcccttcacgcggtcgtccacgcggatggccatgccgcccggccgccgctgcgcggcggtcggcagcgacatccacagcacgtggccggggttcagatagacctcgtcggggtcgcccatcgcgtcgcgcgtttcaatccgggctatcggcatgcagggtctccagtcgaatatcgggcaccgcgtgcgggtgcggcggcaccatgatgccgcaatttgccggcgttccgcgtgtcttgcgacgaagggcgcggcccccgtggcagggcaaccgcgccacgcgcacgcgacttgccgccttgcctgcgtgccgtcggttcgcccatccctgttcgtgcgggaagcaaatgccccggccgggccgcggtcgctacccgccggtggccgctgtcggctccgcgtccgcccgtttcgcgtgaagtcgcaacgcgagccacgcgatcccgaccgcgaccgcgccgaccacgccgccgaaggtgccgacccacggcaacccgaagtcgccggcgatatggttgccgatcagcgcgcccgcgccgatgccgacgttgtacagccccgagaagatcgacaccgcgaggtcggttccttccggcgccagcttcagcacccacgcctgcatggccaggccgaaacagacgatcgccccgccccacaccagcgtgtgcacggacagcgtgacgatgttcagcgcgcacgggaacaggatcagcaggcatcccgcgagcgcgacgatcgacccgagcaggaagtcgtcgggacggtgcggatagatgcggttgaagcagatcgccgccggtatgccggcgatgccgaacaggatcagcacatacgtgatccggctgctgctcgcgtggttgacgctctggacgaagggctcgatgtacgtgtacgacgtgaagtgcgcggacacgacgagcacggtgatcgcgtacagcgccaccagcgcgggcctgcgcaggaacacgccgacgctgccgagcgaccccgcgccctggctcggcgataccggcaacgtggcgcgcagcagcagcaacgcgacgcccgccgcgccggcgatgatcaggaacgtgacccgccagccgaacgtctcgcccaccacgcgcccgagcggaatgccggccaccatcgcgatcgccgtgcccatcgccagcaggctgagcgcacggcttttccggtcgctcggcgcgaggcgcacggccagcggcacggaaatcgaccagaacaccgcgtgcgcgcacgcgatgcccagccggccgaccatcagcaccgcgaaattccacgcgacgccggtcacgacatgactgccgatgaacaccagcaacgccaccgacagcagcttgcggcgctcgacatggcgcgtggccagcgtcagcggcagggacacgacggccaccgcccacgcatagatcgtcagcatcaggccgacgtcggtggcctgcatgtgcaggctgtcgccgatcgcgctgagcagcgcgacgggcacgaattcggtggtattgaaaatgaaggcggtgagggccagggccagtacgccccaccacgagtgcctggaactgactgcgtccggtgttgccatacgtggattcgacgagacgagggttggggcgcgcggcgcggagaacccggcccggcgatcgccgcgattgtaccagcggcgcctgacgcggcgcggcgcggggtggccgcgggacatggtcatgacatggccttgcgccgataatgtgcggcacgctttcacgacccgttcgctcgacctttgtccgctcgcccccgcgagccaggagattcacatgcgcattgaaacgtcatttctgttcgatctcgacggcacgctcgtcgacagcgtctatcagcacgtgctcgcgtggaaggaggcgctcgatgccgaaggcatcgaactgtcggtgtggcgcatccaccgcaagatcggcatgagcggcggcctgttcctgaatcagctgctgcgggagacgtcgggcaacctcgacgccgagcgcgtcgagcgccttgcccgcctgcatgcggccgcgtaccagcggctgcgcgcgcaggtccggccgctgcccggcgcgcgcgaattgctcgccgcgctgtcggcggcgggcatccgctgggcgatcgcgaccagcggacggatggaaacggccgccatcaacctcgaggcgctcggcgtcgatccggcgaagcacgtcgtggtcacgcgcgaccaggtcaagtacgcgaagcccgaccccgacctgttcctgacggccgccgcgcaactgaacgtgccgatcgaacacacggtcgtggtcggcgacagcatctgggacatgctcgccgcgagccgctgccgctcgctcggcgtcgggctgctgtcgggcggttacggcagcgacgagctggaacgcgcgggcgcgctgcgcgtgtacgacgatccggccgatctgctgtggcatctcgacgagatcgcggcgcggccgtaggcgtcggccggcctgtcggcgctgacaacggggctacacgacgggcggtgcagcaattgcgcacaattgtccggcattcacgtcgggcttcgcggtaggcacaaagagcgtgatgcgtacaacgtcaggatcaacgctcactgcgagcgacgcctgcgcgtttttgccaacaaataatgaccacacgcgaatatctgtgaaaccgtgaatttcacgcatgcgagaaacataattagcgattcgcgagtagacgcgattatttaattcgccgatctattacaagatcacctccctgacatcagtggccgcgattccgcatcccggtagactagacgagtttcgatgaacgaataggcgttgccgacacgctgacaggagccgcctgcatctatcagcaagtcaaagcggaaacgctgaggcagcaggaatgcgctgccgttcgtctcctgcgagggctgtccgtttctttacgccggtctagtacgcaggatgatgtgacagttgttttcatttttgccgctcgattttttggggtatggattaattctttccccgtctatttcaaagatcactatcagaagccctatgccggacgtaaagaaagtgccgcattatgaaatcaagacatcatcgatcccattctcattgccgaagtggaaggaatacgctggcgtcagcgggtgtgttcccttgaatacaccgcacggggtttgcatggacaagcttgctccgggtgaacccaagcccctcaagcctcccgagtccaaaccagcaaaacccgaggcgctgaaagcgcctgatccagcaacgacgcctccacccacgcaagcatcgcctcgcaagtcgtccgagccagccgacgccgaagattgcgagcatcccctcccttcgacctgctggatgttcctgaggcgatgaaacgaatgaagtggcctgttgcggccaggctcgccagacgatggttcagtggccccaagcacgtttgggacaacagcttcaaaacggaccagccgtttgacaatgccaccgtcacccttgactgggctctcaagtttgggaaagtcaaaaagcggtatgacgagcttatctcgaaaaatatctacaatgaaaatgccagagcaaggttgagagatatgctgcggcatgtggtgaaagaaaaattcgcatcttcggtagctttcgattttcagacggtcggtgataaaggtaatctcgtcgaattttgcagaaaatggcaatttcagctcgttaacgtgtccagcctcgacacgacaggaggtctcccgtatgcaccgacagatttgacggctgctctggcgaacttcaacatctatgccgccattgggcgtgcggagttttccggagacagatattacaaatacgataatcatgaaaaaccaaatcctactgcatcgacttgaccgcatccataacacatatctatgcgtacataaagatagctattccttcaatgacgagaagtcgccatcgagtagccagtacctgggacactggaataacaatggcatggttattacgaacggaggaagaatcagggagcttctgtatcgaggcggcgtcaattcgaatcttggcaactccatcgaggttgagtcgaagatcaaatggaagtatctgatcgatgatttcctggataaaccgatcgacacgcaaaaggtctagtcaagaaattcagatcgtgtgatgtgtactatcctgttttcaacaaaacctacaacgactggcgaatcaagcataatcgcggagaggattttgtgatatattccgaattacgatatcttaaattgacaaatcccattaaattaagcctgggtgaaatatgcaggtcaccagaaaaatttaatcgtgatcgcgctcgttttggcgctggcgattctgtctcttacattgcggaaatcatacgagggttgcgaaagctatactcgggctcttaacggaggaacgaaagagttcggtggcgagaaatacaaaatcgagctatgtggggcacgtcgctcgtttggcgacggcgacgaaattcggctccaagtgatagggccggcaggggatgtgctggcggagcggtatttcgcggtgcgcacgattaacgatgcggccctcgggaactagagtacggcgacgacaatattttctactacgaccaatcgaagtcgtctccgttgcgcttcgtcgccatgccgccttccaggatggacgggtggacggcgcgaatacctttgctgcaacgactgatcgcgtcattttcatgacgagcagcatgcgatcgtcaggactcgcgtcgatccagcagcgctgccaggacgaccgcacgtctcgatcggggtcgtagcggtaaacataaagggcgcgcgcggatcgctcaccggttcctcccacgcgggccgcgcatgcaacgatgaacacccgtcaccgcaaccgccaagccggtcagtcgtcatccacgcgcttgtcgatcaggtacggaccccgctcgacgcccgcgcgcagcgcgtcgacctcggtcagccactcggggccggccggctccggcacgatcagctcgatgcgcgcgccgccgacacacctgcacctcgtcgcgccacgcgccgcgttcgtcgcgccgggcccagacgaggatttcgtgtccgcgatacgggtcgcgaacctgtgcgtcctggtgatgttgcatggtggcctcctgtccttatctgcgattccgatgcaaaaatgcgcgccgcgtgatcaccgcgcgcgcggcgaaccttgtgcgcacgcgccgtgcccggccggcacgcggcttgcgtgccgttacgtatcgaccgcatcgacagtcttgaccgttccgggccgcctcgcgcgggccgcaaggatttccatcatgatcggccacctcgaacttctcggacgcctgctgctggccgcgctgctcggcagcgtgatagggctcgaacgcgaacgcctgaactgggccgccgggctgcgcacgcacatgctcgtgtgcgtgggctccgcgctcgtgatgctggtgtcgacgttcggcttcgaagacgtgcgcgggcaaaacggcgtcgtgctcgacccgtcgcgggtcgccgctcaggtggtgtcgggcatcggctttctcggcgcgggctcgatcctgctgcgcggcgaagtcgtgcgcgggctgacgaccgccgcgagcctgtgggcagtggccggtgtcggccttgccgcgggcggcggcatggtggttgcgtcggtcggcgcgacggcgatcgtgctcgcgatcctcgcgggcgtgaagccgctcgagcgccgcttcatcgcgcagcgccagcaacgcacgctgcagctcgtggtcgagcgcggcggcctgacgctcggcacgctgcacgaagcgctcggccccggccgggtgcgcgtgaagcggttcatcgtccagcagtcggacgacgatcccgacaccgacgacatttccgtttcgttctcgcgcaccagcggaccggaattcgccgccatctgcgaaacgctgcaaagcatcgcctgcgtacggacctgtcaacccgataccgcgtcaaggagcttcgcgtgacccgcgccgacctgctctcccatctcgtgtcgtgccagctggccgcgcgcatgcggtccggcgcatggctctcgacccgccagctcgtggacgcgctgcgcgcatggctcgcctgccatcgcgccgaatgcggatggctcgagcggatcaagatcgcggacgcctcgacgaccatcgcgcaaggcatctacgccatcgcggtcgcgcacggcgatccggccggcggcgaacgcgtgcggctcgatgcggattcgcccgaactgcaggcgctgcgcgcccgctgcgacgcgctgctgcagcatatcgacggcgaccgggacgtcgacgcgcgatgatcgtgcgggatcacgcgacacgcgccgacgcgcaaacgcgacggccgacagcgccccgcacgttcccgaccgtgtgcccggtgttctcgctggccccgacccgggcccgtccgggcgagcggccggccgacgtggccgtgcatcgcagcgtgcgcgcgcggcatgcgtccgcccactatccatccgccggtcgcgcgaatgcacgtgacgcccgcagcgggcacgtcgcttgcgcggtgagccggtttcgaccggacggagcccacccatgcgaaccgacgccctcgacggacaggcactcgactactggtgcgcccgcgcactgtgcgtggacgacgaagacacgctgcgcttcaccgccgtcacgccgaccgtcgtcgtgacggccgcctgtgacgcgttccggcacctcggcgccccgttcacgccgtcgacatcgtgggccgacgccggcacggtactcgaccgcgtcgacgatctgcggatcacccgccacggcgacgacgtcgaatgcgacgccaccttcgccgacggcccgtcgacctgcggcgcgcacgcccgcgatgcccgcgtggcgctgctgcgcgcgttcgtgcgcgcgcgcttcggcgacgagatcgacccgccgccgccgttcgcgcaccggatcgaacacggcgccgtggtgcgctacgaccccggcgcgccgctgcccgacgcggacgacgatcgcggcacgggcgacagcacggacatccgctcgataccgcgcatgtaagtgcatgcatgtacccggcgttcatgtaaaaacgacagtcccggtaccggccggcttcccgcacacgccttgcccggcgggacaccgcccggcgggcacgcgcgttgcggcacatcggcgctatcgactgccgccacccgccccgcgccacgccatggactccacgccgacctttgccccgcatatctatttctgcgacgcccgcctcgtcgggccgctcgacgcatggccgcagacattcgcgcacatcgcgggcatgggcttcgatcacgtgctggtcggcggcttctgggccgcaagcgtcgccggctttccgcgtcacgtggccgatttccggcgtccggcccactcgttcgcgacacgtgcgagcgcactcgaaaccttctcgcggctcgcgcagctcgcgcacggccacggcctgcgcctgctgctcgaagccgtgccggatcgcgtcgcgcgcgacaacccgctgcgcgccgagcatccggactggtacgtcgagcgcacgcacgacgacgcgctgatcgatccgcgcggcaccgcgcacgcgctggacgtcgcccacgcgaacctcgacagcgacgcggtacgcgacgggctttccgcgtggtggtgtgcgcacctctgcgcattcgccgatgcgggtgccgccggcttcctggtcgacgcgccgcatcacctgccggccgactggtggcccggctggcgcgcggcgctgcgccgggcgcgcccggacgtcgcggtgctcgcgggcgtgcccggccatgcgcgggacgcgctcgcgcagctcgaaggcaccgggttcgacgcggtgttttcatcggtacgctggtgggacctgcgcgcgccgtggttcgtcgacgaacaccggctgctgcggcgcatcggctcgccgatcgcgtttcccgacgcattcgacggcaagcgcctcgccgacgactggcccgacgcgccggacgataccgtcgcccgcgcctatcgccgcgcgctgtggacggccgcggccgtcggcaccggctggctcgtgccgatgggcttcgaacgcggcgtcacggtgccgctgatggcgcgcgacgccgatgcggcgcgctaccgcgccgcgttcgagcgcgcgcgcttcgacctgtccggcgcgatcgccgatgcgaacgcgtggcgccgcgccacgcccgtcgcggccgcgcgcggcgagatcgtgcagctgagcgcgcccggtgcggcggcgaccgcgctgctgcgcggcatcgggccgtcgctcgaacacgacgaagccgcgctgctgatcgccctgaatcccgatctcgacgcggcggcaacggtcgacccgcgacgatcctgcccggcgtgccgggcggcttcacgcgggtcgtcacgcacgacggtgcgcaagccaattcgcccgccgcgctcgaaccgttcacgctcgaacccggcgcatacgcgctgctgcatgcgtggccggcaccgcccgccacgacacgcgccgacgccgcgcgcgagcgcggcgcgctgtccgccgcgctcgcggccgaccggatcgcgatcgagcacgtcgagccgtcggtcgacggcggccgcttcgcggtcaagcgcgtgatcggcgagacgctcgtcgtccatgcatcgatcttcaccgacggacacgcgcatctcgcggccgcgctgcagtggcgcgccgcctgcgacgacgactggcgcgaaatcccgttcgaagccgaaccgaacgacggctggcacgcacgcgtcacgctcgaccggctcggccgccatgaatttcgcgtgatcgcatggcgcgacgactgggcgtcgctcgtcgacgatgtcgcgaagaaagacgcggccggccaggacgtgacgctcgaactgcgcgaagcgcagctgctgctcgcgaccgcgctcaggctcgccgatccgctcgatgcgcgcgcgctcgcgcggatggaacagctggccgccgggttcaaggacgcaccggccgacgcgcggctcgcgcaactcggcgcggcgccgctcgccgatgcgttcgcggcgctgcgctaccgcccgttcgtcacgcacacggcgcccttcccggtcgacgtcgagcgccgcgcggcgcgcttctcgagctggtacgagatgtttccgcgctcggcgagcgacgatccggaccggcacggcacgttcgacgacgtgatcgcgcacctgccgcgcatccgcgacatgggtttcgacgtgctgtatttcccgccgatccacccgatcggcacgaccgcgcgcaagggccgcaacaacagcctgacggccggccccgacgacgtcggcagcccgtatgcgatcggctcgccggacggcggccacacggccgtgcatccgcagctcggcacgctcgaatcgttccgcgcgctggtcgacgccgcgcgcggtcacgggctcgagatcgcgctcgatttcgcgatccagtgctcgcccgaccatccgtggctcgccgcgcatccgggctggttcgcgtggcggcccgacggttcgctgcgcttcgcggagaatccgccgaagcgctaccaggacatcgtgaaccccgatttctacgcgcccgatgcgttgcccgacctgtggctcgctgcgcgacgcgatactgttctgggtcgacgcgggcgtgcggatcttccgcgtcgacaacccgcacacgaagccgctgccgttctgggcgtggatgatcgacgacgtgcgcggccggcatccggacgtcgtgttcctgtccgaggcgttcacgcggccgggaatgatgtatcgcctcgcgaaagtcggcttctcgcagtcgtacacgtacttcacgtggcgcgagtcgaagcgcgaattcatcgactacctgaccgagctgacggccggccccgcgcgcgagttcttccgcccgaacttcttcgtcaacacgcccgacatcaacccgcgccacctgcagaacgcgccgcgcacgcagttcgtgatccgcgcggcgctcgcggcgacgctggccgggtcgtggggcatgtactcgggcttcgagctcggcgaatcggcgccgctgccggacagcgaggaatacgcgaacgcggagaagtacgagctgcgcgcgcgggactggcgccgcgccgcgcacatcggcgccgagatcgcgcgtctgaaccgcgcgcggcgcgctcacccggcactgcagacgcacctcggcatcacgttcgccgacgcggacaacgacgcggtgctcgtgttcgtgaaggcgacaccggcgttcgacagcgtggtcgccgtcgcgatcagcaccgacccgtggcatccgcaggtcgcgaacttcacgctcgacgcatcgctgtggcgcggtttcgggctcgtcgacggcgaaccgctcgacgcgctcgaacaggacgccacgcacgcggaaacctggcgcgggcatcgccagtacgtctcgctcgatccgcacgtgcggccgtatgcgatctggcggctcacgccgtctccaggcgccgcgcgggcggcggcgcgcgaaccgggcgacgcccggcccatttcgggagcccatggatgatgaaacgcgaagattccctcgacgacgtacgtcgcgcacagttcccgtcgctcgagccggccggcacgccgcgccggcgccgcgcgcgccgccgcgcaccggcactctgcgcggacgatccgctgtggtacaaggacgcgatcatctaccaggtgcacgtgaagtcgttctacgactcgaacaacgacggcatcggcgatttcccggcctgatcgcgaagctcgactacatcgccgaactcggcgtcgacacgatctggctgctgccgttctacccgtcgccgcgccgcgacgacggctacgacatcgccgactaccgcgacgtgcaccccgactacggcacgctcgccgacgtgcggcgcttcatccgcgaagcccatgcgcgcggcatccgcgtgatcaccgagctggtgatcaaccacacgtcggaccagcatccgtggtttcagcgcgcacgccgcgcgaaaccgggctcgaatcaccgcgactactacgtgtggtccgacaccgacacgaaatacgcgggcacgcggatcatcttcctcgatacggaaacgtcgaactggacccacgacccgctcgccggccagtactactggcaccgcttctattcgcaccagcccgacctgaatttcgacaacccggccgtcgtgcgcgaggtgctgcaggtgatgcgcttctggctcgacctcggcatcgacgggctgcggctcgacgcggtgccgtatctggtcgagcgcgaaggcacgaacaacgagaacctgcccgagacgcacgcgatcctgaagcagatccgcgcgacgatcgacgccgagtacccgaaccggatgctgctcgccgaagcgaaccagtggccggaggacgtgcaggagtatttcggcgacgagaacgaatgccacatggcgttccacttcccgctgatgccgcgcatctacatgtcgatcgcgagcgaggaccgcttcccgatcgtcgacatcatgcggcagacgccggcgctcgcgccgagcaaccagtgggccgtgttcctgcgcaaccacgacgagctgacgctcgagatggtcaccgactccgagcgcgacctgctgtggcagacctacgcgagcgaccggcgcgcgcggctgaacctcggcatccggcgccggctcgcgccgctgatggaacgcgaccggcgtcgcatcgagctgatcaactcgctgctgctgtcgatgcccggcacgccggtgatctattacggcgacgaactcgggatgggcgacaacatccatctcggcgaccgcgacggcgtgcgcacgccgatgcagtggtcgtcggaccgcaacggcggcttctcgcgcgccgaccccgaactgctcgtcttgccgccggtgatgggctcgctgtacggctatgacgcggtcaacgtcgaggcgcagacgcgcgacccgcattcgctgctgaactggacgcgccgcatcctgtcgacccgccgcgcgtcgcaggcgttcgggcgcggcacgatccgcttcctgcgcccggagaaccgcaaggtgctcgcgtacctgcgcgagctggacggccacgatccggtgctgtgcgtcgcgaacctgtcgcgcgcgtcgcaggccgtcgaactcgacctgtccggattcgcgggccgcgtaccgatcgagatgacgtcggattccccgtttccgccgatcggccagctcccgtatctcctcaccttcccgccgtacggcttcctgtggttcgtgctcgccgaacatgggcgcgagccgtcgtggcggcagccgcacgcggaagcgctgcccgaatacgtgacgctcgtgatgcggcgcggcgaggcgcggccgaacctcgagcagctgcacacgcttgcgcacgacgcgctgccgtcgtggctcgcgcggcggcgctggttcgcgtcgaaggaccgcacgatcggcgaagccaggctgaacgtcgtcacgccggtgccgggcgagccgttcgagtatgcggaggcctgggtcgaagcgggcgcgcagcgcgacgtcgaacgctacgtcgtgccgctcgcggccgcatggggcggcgagacctcgcagccgctgttcacgcagctcgcgctcgcgcgcgcggcgcggccacacgatcggctacctgaccgacgcgttcgcgctgccggcgttcgcacgcgggatgctgcgcaagctgcgcgacggcgccgtggtgccgacctccgacggcggccgcctcgcgttcctgccggaagacgcgctcgccgcgctcgaccccggcgacgacgccgaagtgcgctggctcgcggccgagcagagcaacagctcgctcgtgatcggcgacgcgatcgtgctgaagctggtgcgcaaggtcgcgcacggcgtgcatccggaagcggaaatgagccgctacctgacgcggatcggctacccgaacaccgcgacgctcgcgggcgaagtcgtgcacgtcgacccggacggcacgccgcacacggtcgcgatcctgcagcgctatgcggacaaccagggcgacgcgtggacgcgctcgttcgacttcctgcgccgcgcggtggacgaactcgcgctgccggctgcggacaacgacgaaaccgacgaagcggacgaggaaccggaagcgctgctcggctacgcggcgttcgcgggcatcatcggcacgcggctcggccagttgcacgtcgcgctcgcgcagccgtccgacgaccccgcgttcgcgccggagcgggcgacgcccggccatgtcgacggctggtgcgcggacgcgatcgcgtcgttcgagcaggcgctcgacgtgctgcacacgcggctcgaggcgctcgatcccgcgatgcgcgcggcggccgatacgctgctcgcatcgcgcgacgcggccgtgcgggccctcggcgcactcgtgccgcgcacgctcgacgcgcaatgcatgcggattcacggcgacttccatctggggcaggtgctcgacgtgcagggcgacgccctgctgatcgacttcgaaggcgagccggcgcgcccgctcgagcgccgccgcgcgaagtcgcatccgctgcgcgacgtggcgggcctgctgcgctcgctgtcgtatgtgagcgcgaccgcgcagttcgcgatcgagaaggcgccgccgcaggcggccggccgcaagcgtgcgctgttcgaccgcttcgggcaggccgccgccgaccgtttcgtcgactgctatcgcgcggccgccgacctcgcgcccgcacgcttcgtcgatccgcgctacgccgaccgcctgctcgcgctgttcctgatcgacaaggcgtcttacgagctgtgctacgaagcggcgaaccgccccgactggctgagcgtgccggtcggcgggctcgcggcgctggtcgaacggctgctcgacgacggcggcgcatccgacgacggaggcacgcgatgaccgatacgctgttcgaacggtccgacatcgacgcgctgctcgccgggcgtcatcccgatccgttcgcgtgcctcggcccgcacgggcagaccggccgcaccgtcgtacgcgcgctgctgcccggcgcgaccggcgtgcacgtgctgtcgcccgacggcgacgaactcggcacgctcgactgcgtcgatcgcgccggctgcttcgcgggaacgatcgcgcgcaacggcggcgcccgcactacctgctcgcggtcgactggccggacgcgcggcaggtgatcgacgatgcgtacgcgttcggcacgctgctcgacgacgcgacgctcgcgcgcctgtcggccggcgacccggccgcggtgctcgactgcctcggcgcgacgcccctgcgcatcgacgacaccgacggcgtgcgcttcgcggtctgggcgccgaacgcgcagcgcgtgtcggtagtcggcgatttcaacgcatgggacggccgccgccatccgatgcggctgcggcagccgtcgggcgtgtgggagctgttcgtgccgggcatcggcgcgggcgagtgctacaagtacgagctgcgcgcggccgacgggcgcgtgctgccgcacaaggccgacccctgtgcgcgcgcgaccgaggcgccgccgcgcacggcgtcggtggtcgccgacgtcgccgcgctcgacgcgttcgcgtggcacgacgagggctggatgcacgcgcggccgcgtgccgaccgctaccgcgtgccgtggtcgatctacgaggtgcacccggaatcgtggcaacgcgtgcccgacgagatgaaccgcagcgcgacgtgggacgaactcgccgagcggctgattccgtacgcgcggggcacgggcttcacgcatatcgaattcatgccgatcgccgagtacccgttcggcgggtcgtggggctaccagccgctcgcgcagttcgcgccgtccgcgcgcttcgggccggtcgacggcttcgcgcgcttcgtcgaccgcgcgcatgcggccggcatcggcgtgctcgtcgactgggttcccgcgcatttccccgacgatccgcatggcctggcgcagttcgacggcaccgcgctgtacgagcacgccgacccgcgcgaaggcttgcatcccgactggcacacctgcgtgttcaacgtcgggcgtacggaagtcggcgcgttcctcgccgcgtcggcgctcgcgtgggcgcgccggtatcacgtcgacggcatccgcgtcgacgcggtcgcgtcgatgctgtaccgcgactattcccgcaaggaaggcgaatgggtgccgaacgtgcacggcggccgcgagaacctcgaatcggtcgcgttcctgcgcatgctgaacgacacgctgcacggtgcggccgcgccggccggcgtcgtcaccgtcgcggaggaatcgaccgcgtggccgggcgtcaccgcgccgaccggcgacggcgggctcggcttcgacttcaagtggaacatggggtggatgcacgacacgctcgcgtacctgcgcgaagacccggtgcaccgccgctatcaccacgaccggatgacgttcgggctcgtctacgcgttctccgagcgcttcgtgctgccgctgtcgcacgacgaggtcgtgcacggcaagggctcgctcgtcgcgaagatgccgggcgacgcgtggcagcggctcgcgacgttgcgcgcgtacttcggcttcatgtgggcacaccccggcaagaaactgctgttcatgggcagcgaattcgcgcaatgggccgagttcgcgcacgacgcgacgccgcactgggacctgctcgacgcgcccgcgcatcgcggcgtgcagcggctcgtgcgcgacctgaaccgcacgtacgcggcggaaccggcgctgcatgcgctcgactgtcacgcggccggcttctcctggctgatcggcgacgaccgcgacaacagcgtgttcgcgttcgcgcgccgcgacgacgccgggcacctcgtggtcgccgtctgcaacttcacgccggtgccgcgcgcggcctaccgcatcggcctgcccgccccgggcagtggcgcgaactgctgaacaccgatgccgccccgtacggcggcaccaacgccggcaacgacggcgccgtgtgggccgaggccgtgcccgcgcacggcgaggcgtggtcggcactgctgcgccttccgccgctcgcgacactgtggctgacccccgcctgattacccgcgccctcgacacggagatccgccccatgccgaccgccctgcccgcccgtctcgaatccggccgcagctatccgctcggcgcgacctgggacggcctcggaaccaatttcgcggtgttttccgcgcacgcgcagcgcatccagctgtgcgtgttcgatccgaccggccgcaaggaactcgcgcgcctcgacctgcccgaatgcaccgacgaggtgtggcacggctacctgcccaacgcgcatccgggcaccgtgtacgggtttcgcgcggacggcccgtaccagccgcagcacggccatcgcttcaattccaccaagctgctgctcgacccgtacgcgcgcaagctggtcggccagttccgctggtcggacgcgctgttcggctatcgcgtccattcgaatcgcgcggacctgtcgatggaccgccgcgattcggcgcccgcgatgccgaagtgcgtggtggtcgacgaggcgttcgactggagcaccgaccggcgcccgcgcgtgtcgtggcgcaacacggtgatctacgagacccacgtgcgcggcacgtcgatgcgccgcgccgggttgcgcccgcccgaacgcggcacgttctcggcattcgcgcatcccgcgttcatcgatcacctgctgtcgatcggcgtgacgacggtcgagctgctgcccgtccacgcgttcctgcagcagcgcgctcgtgaaccgcgggctgcgcaactactggggctacgacacggccgcgttcttcgcgccggagcccgcgtatctcgcgacgcggcggctcgacgagatgcgcatcgcgatccggcagctgcatgcggccggcatcgaggtcgtgctcgacgtcgtctacaaccatacgtgcgagggcaacgagctcggcccgacgctgtcgtggcgcggcctcgacaacgcgagctactaccggctcgtgccgggcgaccagcgctttcatgtcgacgagacgggctgcggcaacacgctgaacctgtcgcatccgcgcgtggtgcagatggtgatggattcgctgcgctactgggccaccgcgttcaacgtcgatggcttccgcttcgacctcggcgtgacgctcgggcgcgaggcgcacggcttcgatcctggcgcgggcttcttcgacgcgctgcggcaggacccggtgctcgcgcagcgcaagctgatcaccgagccgtgggacctcggccccggcggctatcagctcggccgccatccgcccggtttcgccgagtggaacgaccgctttcgcgacaccgtgcggcgcttctggcgcggcgacgcgggccagcggccggagctcgccgcgcggctcgccgggtcggccgacctgttcaaccaccagcggcgccatacgtgggcatcggtcaatttcgtcaccgcgcacgacggcttcacgctcgccgatctcgtctcgtattcggcgaaacacaacgaagcgaacggcgaggacaaccgcgacggccgcgacgacaactgcagcgcgaactggggcgccgaagggcccaccgacgatgccgcgatccgcgcggtgcgcgcgcgcgtcgcgcgctcgatgctcgcgacgctgttcaccgcgctcggcacgccgatgctggtggccggcgacgagttcggccgcacgcagcacggcaacaacaacgcgtattgccaggataacgagctgtcgtggctcgactgggacctcgctcacggcgacgaagccgtgacgctgatgcgcttcgtgtcgcggctcgccgcgctgcggcgcatgtatccggtgatgtccgcgccgggttatccgtcgggcgaccgcgacgccgcaccgggcatggccgagatcgactggttcgacgagcgcggcgccgcgatgaccgtgcccgcgtggcaggaccgcgaacgccgcgcgctgacgatgcggcgtgtcggcacgggccgcaccgggcgcaccgaggcgctgctggtgatgctgaacgcgtcgtccgagacgatcgtgttcgcgccgcccgcgccggtgctcgaataccgcgtgctggtcgacacggctacgccggacgccggcccgcgcaactggccggccgacgggctcgacgtcgccgcgcatgcagccgcgatcgcggtggccgccgtgccgcccgacccgccctcctgaggaccgccatgacatcccgttccgaccgtccaaccggcacgcacgcgttcgaatcgtcgttcggcgcgacctgcgtcgacgccgaccgcacgcgcttccggttttgggcgcccgccagccgcacggcagccgtcgaactgcacgacgacagcgaacacacgatcccgatgacacccgtcggcgacggctggttcgagacggtcgcgccgtgcggcccgggcgcactgtatcgctaccgcctcgacgacggtttcaccgtgcccgacccggcgtcgcgcttccagcccggcggcgtggacggcccgagccaggtcgtcgatccggcgtcgtatcgctggcgcgacggcgcatggcgcggccggccgtggcacgagacggtgctgtacgagttgcacgtcggcgcatgcggcggctacgcgagcgtcgagcggcggctgccggccattgccgcgctcggcgtgaccgccgtcgagctgatgcccgtcaacgcgttccccggttcgcgcaactggggctacgacggcgtgctgccgttcgcgcccgacgcgtcgtacgggcggcccgaggagctgaaggcgctcgtcgacaccgcgcacgggctcgggctgcaggtgttcctcgacgtcgtgtacaaccacttcggcccggaaggcaacctgctgccgcgctacgcgcccgccttcttccgcgacgaccggcggactgcctggggcccgcgatcgatttttcgcacccgcagacgagcgcgttcttcatcgagaatgcgctgtactggctcgaagaattccgtttcgacgggctgcgcatcgacgccgcgcacgcgatcggcgacgacgcgtggctgcgcgaactcgcgcgccgcgtgcgggcggttgcgggcgacacacgccaccttcatctcgtgctcgagaacgaacgcaacacggcgagcctgctcggccccggcggtttcgacgcgcagtggaacgacgacttccacaacagcgcgcacgtgctgctgaccggcgagcgcgacggctactaccgcgcgtacgccgacgcgccgctgcgccatttcgcgcgcacgctcggcgaaggtttcgcgtaccagggcgaaccgtcgccgctgcacgacggcgccgcgcgcggcgagccgagcgcgcacctgccgcccaccgcgttcgtcacgttcctgcagaaccacgaccagatcggcaaccgcgcgttcggcgagcggctgcgcgcgctcgcgaacgacgacgcggtgcgcgcggccaccgcgctgatgctgctcgcgccgccgatcccgctgctgttcatgggcgaggaagacggcagcacgcagccgttccagttcttcaccgactaccgcggcgcgctcgccgacgcggtgcgcgaaggccggcgccgcgaattcgcggcgtttcccgcgttcgccgatcccgcgcatcgcgacctgattcccgacccgaacgacatcgcgacgttcgtccgttcgtcgtcgcaccatccgccggacgacagctggcccgatgcggccgcgtggcagcgcttctaccgcagcgcgctgacggtgcgcgcggtgctcgtgacgccgcatctgccgggtgcgcgggcgctcggcgtcgacctgctcgcgggcgacggcgacccttcggcgctcgtggcgcgctggcgcctcggcgacggcagcacgctgacgatcgcgctgaatctcggctcgctcgacgcggcactgcccgaactgccggtcggcaagatcgtgttcgagacgccgccgcgcgcccgcgaccggctgaccgatctgaagctgccgccacgcgcgtgcatcgcgtggcgggacggtgcggtcaatcacgatgcgcggcatcatcgcgcgaacgggcagagccgatcatgacgaccgacgtttcgatctcgaccctcgcgcacgcggccggcctggacgccgactggaccgatgccggcggcatcgcgcggcgggtggacgatcgcgcgctcgccgcgctcgtcgatgcgctgggctggccgtgcggcacggcggctcagcgcgtcgacagcgcggcggcgctcgcaggcggacatgcggcggtgccgcgcgtcgtgaccggcgacgcgggcctgccgctgcccctgcccgccgcgctcgcgcaaccgggcgcgcgcttccggatcacgctcgaagcgggcggacacatcgacgggcgcgtggatgcgcacggcgcgctgccgccgctcgcgatgcccggttaccacgcgctcgacgtcggcgaccggcgcatcgggctgacgatcgcgccgccacacacgcacccgttcgacacgcgtgcgacggatgcgggcaaccgctggggcatcgcggcgcagctctacagcctgcgccgcgcgggcgacggcggcgcgggcgactacaccgcgctcgcgcggctggccgcgcgagcggcgcggcatggcgcgcaggcggtggcgatcagcccgacgcacgccggctatccggcgctgcccgcgcacgacagcccgtattcgccgtcgtcgcggcgctggcacaacgtcgcgtatctcgactgcgacgcggtgccgggcgccgagtccgtgcgtcacgtagccggtgcggcagccgatgcgccgctgatcgactggccgcacgtgctgccgctgaagctgcgccgcctgcgcgcgtgcttcgacgcgtggcgcgccgacgacgccccgtcgcgcgacgcgttccagcggtttcgcgcgacgggcggcgcggcgctcgacgcgcatgcgcgcttcgatgcgctgcaggcgttctgcctcgaacacgggctcggggcggactggcggcagtggccggcgccgtggcgcgacccggcatcggcggaagtcgacgcattcgcgcacacgcatgccgatacggtcgcgttccatacgttcctgcaatggtgcgccgcgcgcgctcggcgacgcgcagcatgcggcacgccgcgccggcatggccaccgggctgatcgccgatctcgcggtcggctccgatcgcgcgggcagcgacgcgtgggcgcacggcgcgacgctgctgcgcggcgtatcgctcggcgcgccgcccgacctgttcaacgcggccggccaggcgtggggcgtgacgacctggacgccggacgcgctgcgcgcggaaggtttcgtgccgttcatcgagctgctgcgcgcggcgttcgcgcacgcgggcggcatccgcatcgatcacgtgctcggcttcgcgcggatgtggatcgtgccggacggcggctcgccgcgcgacggcgcgtacctgcgttacccggtcgacgatctgatgcggctcgtcgcgctcgaggcggcccgccatcgcgcgctcgcgatcggcgaggatctcggcacggtgcccgccgggtttcgtgaacggctcggcgcgcagggggtcgcgggcatgcgcgtgctgtggttcgagcgcgacgcgggcggcgcgttccggcagccgtccgagtgggaccgcgacgcgatcgcgacgacgtcgacacatgatttgccgaccgtggccggctggtggcgcggcgtcgacctggcctggcggcaagccgcggcccaggtcgccgcgcagcacgacgagccggacaggcacgacgtggccgctcccgcgccggacgacgccagtgcccacgattccgacgaaatcgtgcaggcgcgcgggcacgacaccgcgccgcgcccggaagccagcaacgcggcgccgcccgacgcgccccgagccttcccgccgcgcacgcggaacgcgccgccgaacgcgcggcgttatggcacgcgctgcagcaggccggctgcgcaccggccggcgccgccgccccgccggccgatgccccgccggtcggcgcgatcctcgcgtacgtcgcgcgcagcccgtcgccgctcgcgatcgtgccgctcgaggacctgctcgcgctggacgcgcagccgaacctgccggggccgccgtgcgggcatccgaactggcggcaacggctgccgcgcacaatcgacacgctgttcgacgccgacgtgcgcgaacgcatcgccgccgtcgtgcaggcgcgccgttcaaggagcgcggcgcatgacgccgcgcgcgacgctgcggttgcagcttcatgcgggtttcacgttcgacgacgcggcctcgcacgccgactacttcgcgcggctcggcgtgagccacctgtacctgtcgccggtcgcgaccgccgaaccgggctcgcggcacggctacgacaccgtggattacggcacgctcaatcccgaactcggcggcgaagcaggtttcaatcggctcgtcgacgcgttgcgcgcgcgcggcctcggcgtgatcgtcgacatcgtgccgaaccatatgggcgtcggcggctcgtcgaacggctggtggaacgacgtgctcgaatggggccccgccagcccgtacgcgcgccatttcgacatcgactggcacccgcccgatccggcactcgacggcaaggtgctgctgccgtgtctcggcctgccctacggcgacgcgctcgcagccggcgacatcacgctgggcgccgacccggccagcggccgcttcttcatcgcgtgccccggacggcggctgcccgtggcggccgccacccatgccgacatcctgcgcctcgccaaccgcgcggacctgaacgcgctcgccgaacgcttcgacgccgcgccggcgcgcgacagcgcacggctggccgccgcgcatgccgcgctgcgcgattacgcggccgcgcacggcccgcacgcgcttgacgcggtgctgcgcggcgccgacccgcgcgtcgcgcgctcgcgcaccagcctgcaccggctgctcgaacgccagcattaccggctcgcgtggtggcgcacggccgccgacgagctgaactggcggcgcttcttcgacatcgcgacgctcgcggccgtccgcgtcgacgacgacgcggtgttcgacgccgttcacgcgctgccgttgcgcctgcacgcggccgggctcgtcgacggcatccgcgtcgatcacgtcgacggcctcgccgatccgcgcgcctactgccggcggctgcatgcacgactggccgcgcagcgcagcgcgccgccatatgtcgtcgtcgagaaaatcctcgcgccgggcgaatcgctgcgcgccgactgggccgtcgccggcacgaccggatacgacttcatgaacgacgtcggcgcgctgctgcacgacccggccggcgccgaaccgctcgccgcgcactgggcggccgtgtcgggctcgtcgcgcacgttcgcgcaggaagcgctcgacggcaagcggcgcgtgctgatgcgccagctcgcggtcgaacatgcgcgcgccgcgcggctgctgcacgggatcgcgcgcgcgtcgcccgccacgcgggacgtcagcctgatcgcgattcggcgcgtgctgggcgaactcgcggtgcggctgcccgtgtaccgaatgtatccggctccgcgcgaggagccggccgatgccgaccgccgcgtgctcgcgcacgcgtacgaaagcgcgcgcacggccatcgatccggccgaccggttcgcgctcgatcgcgtcgccgcgtggctgggcttgccggccgcacgcgtgccgcgcgcgaacgccgacgcgctggccgcggcgcgcgtcgcgttcgcgcagctcaccgcgccgctcgccgcgaaaggcgtcgaggatacggcccactatcgctacggccggctgctgtcgcgcaacgaggtcggcgccgatgccggcgacttcagcctgtcgcgcggtgcatttcacgcacgcaaccggcgccgcgcgcgcaccgtgccgcacgggctcgtcgcgacggccacgcacgaccacaagcgcggcgaggatgcgcgtgcacggctcgcggtgctcagcgagatcccggacgcatggcgcacggtatcgctcgactggagcctgctgaacctgccgcaccggggccgcgcgcatcgcgatctcgcgtgggcgccggggccggccgcggaggcgatgctgtaccagacgctcgtcggctgctggccgccggcactcgcgcccgacgatgcggccgggctcgccggactcgccgcgcgcgtcgcgcagtggcagacgaaagcattgcgcgaagcgaagcggcacagcgactggctggcgcccgaaccggactacgagcatgcctgcgaaacattcgtccgcgcgatcctgacgccgcgcggcgccggcgatttcgtgcaccggctgcatgcgttcgtcgcgcggatcgcaccggccggcatcgtcaacagcctgacgcagacagcgctgcggatcgcgtcgcccggcgtgcccgacctctatcaaggaaccgagtgctgggatcactcgctcgtcgatccggacaaccggcgcgacgtgccgttcgacgcactggcggccgaacgggtcgacgatccggtcgcatcgtacctgccggcctggcccgacgcacgcgtgaaacgcgcgctgatcgagcggatgctcgcgctgcgcgcgcggtggccggcgacgtttgcggacggcacgtacgtgccgctacgcgtgcgcggcccgcttgggcgtcacgcggtggcgttcgcgcggcgcgacgcggccgccaccgtggtgatcgtcgcgacgcggctcgcgagccggttgctcgggaagcgcccgggataccgcgcgtggcgcccgcgcagtggggcgatacggcggtcgtgctgccgcgcggaatcgcggggccttggatcgactggctgaatggtcgggacgcgatcgatgcgcccgacggggtactggcgctacgccgctgcctggccggattgcctgtagcggtgctcgtggcggcgcgtgccggcggttgaaagctgcccggccctgccggtgcgtgtcgtacctcgcacaccggcgatcgtcaatcgaatcggccgaacgtcagcgatcttgcgcaagtgcccagacgcgattgccccgtcacgaccactcttccggcggcattgcgccgccgtcgtcctcccatagcgggttgcccttcctgtcgccgtcgtgcgcggccacgggcccgcttgagccgctcgagccgcttgagccacctgagccgcgcccggccggccgacgcgcgtcgcgcgacgccggcttggccgctcgcacgcgtgggcgcgtcggcgtcaccgtgtgcggatcgccgctgcggcgcgcgtcggtcgcgctcgtctcgctcgtctcgctcgtctcgctcgtcttgttcgcctgtcgtgcattcgaagccgcgttcatcctcgtctcccgtgtcatgaaaaacggacgaacgatcgccgcaatttcggtgccgccgccgggcaagcatcttgctgatcacgttcatgccgaaccaacgtccggaggaagccatgccgaccgaccgtacccccgcccgccacgcgccatcggctcggcgaatggatggcgcgcgaagaggcccacatggccgcgttccgcgaagggatcgcggcggaagcccgtgcgcatgccggcgaccggttgcgcacgccggccgtgcaggcgctcgcgcggctgttcgacgaccatgccgtgctgcgcatgggcctgacccgcgcaatcgacgaggcgctcgacgcgggcctgcggctcggctacgcgtcgatcggcgagctcatgacggtgctcgatcacctgatgacctatacgccccctttcagcgaaacgagcctgatcgtgtgcccgatcaacgcgttcctcgactggccgatgtgcatgccgtcgggccatgcggtgtttcgcgacgcgaccgtcaacgcgcacctgaagcgcgtgctgaacgtgtggtgcgacttcctcggcggcccgcattcgcgcacgcatctcgacacgtcggcgcccgacggctggttctgcgacgcagcgtgcaggcgcctcgggctgtcccagttcgagtatcgcgacgaccagccgcacctgggcttcgactcgtggaacgacttcttcacgcgacgctttcgcgacggcgcgcgcccggtcgaggcccccgacgatccgcacgtgatcgtcagcgcatgcgaggccgcgccgtaccacaccgaatcgaaggtgaagctgcgcgacacgttctggatcaaggcgcagccgtattcgttgcgcgacctcttcacgcccgcatggctgccgctcgccgagcgcttcgtcggcggcgacatctaccaggcctacctgagcgcgtacaactaccatcgctggcatgcaccggtgcgcggtgtcgtcacgcacgcgtaccgtgtcgacgggacctactactcggtcgcggaggcggaaggcaccgatccggccgggctgaacgactcgcagggttacatgacggccgtcgccacgcgcgcggtggtcgcgctctcctgcgacgaccccggcatcggcaccgtggcggccgtgttcgtcgggatgggcgacgtgtcgtcgtgcgtgatcgacgtcgtgccggggcagcgcgtcgacaagggcgacgagatcggctacttccagttcggcggatcgacgtactgcctgctgttcgaagccggcgtgatcgaccgcttcctgcccgcgccgccgttcgacgaccggacacctgtcgtacccgtcaacgcgggcgtcgcgatcgcgcggtgaacgccgctcggcgccgcgcatcacgcgtcgttcaggtcgctcaggtcggacacgtcggtcgcgaccccgtcatgccgctgcacgcacttcagaaccgacaagccgccggccgtcaacacgggccgacgctcgccggacgtgtcgtcgcgctgcatctcgatcaggcgttgctcgacgagggcgacgacgtcgtcgcggtcgatctggatctgttccggcgcgtgatgcaccaggaacagcacggcaaattcatgggcggtcagcatgctcgttccccgtctgcggctacgtgcgatgcgacgaacgggtcgcatcggcatgcggcgcgaatcgtgcgccggcaacaggccattcatgcagggaacatgccagtcgacaccacgcgaactgcaccgcgcgcgcgcgcgcgcgcgatgtggcaccgggcaacgcctgcggcgcgcggcaaagttttcaatggcgtgtaatgcggttggccggatggcctgacggctggatgcggcgcggaatgacgcttcgggaagcgcgacggaggtcaggacttcccggaccaaacagcccggcccgcgcccgaccgcccggcgcacggaaataaccgctatgcagcaccacgtccgccccgccgccgtcggccagcacttccgcgcacgcggcctcgatgcgcgcgcggccgcgttcgaacgcatcgcgcaggtcggcctccagcgcggactgcgcgccgaaatgatcctccagcgcctcgaccgtgatcgcgcaggtctgcggtatgccatcgacgtcgacgacgaaactcaactgcagcgccgctccatcgaacacgggcggcgtgtcggtcagcgtcacgcggcgggcggaatcggccggcatcggcttacgcccccgcgacgcgaggcgctcgaccagcgcgccattgaacgcgggcaggtcggcgggcttgcggctcgtgatcaggttgccgtcgcgcacgacctcctcgtcgacccacttgccgcccgcatgacggatatcgtcctgcaggctcggccagctcgtcatcgtgcggccctccacgagcccggccgacacgagcagccagccgccgtggcagatcgccgcgatcggcttgccggcgccgacggccgccgtcacgaattcgcgcgcggccggcagcatccggatcgcgtcgccgttcacgacgccgccaggcagcacgaccgcgtcgtaatcgccttcgcgcgcgtcgtcgaacgtgcggtcgaccttcacgcgctcgcccttgtcgacgtgccggaaaccctggatctcgccgcgcttctgcgaaatcacgtcgacctgcgcgccctcggcggcgagcgcgcgctgcggctcgacgagttcggcttcctcgaatccgtcgaccgcgaggatggccaccttgcaatgctccagcctgccgctcatgaacgtctccttcggatggacggcacacgtcgtgccgcatcggtcgtgcagcaatcggcgtgccggccgccgggcgcgctgcacctgcacgcgcagggtcgcacccgctcgcatcgcgaccccggccggggaacgacccgcgatcgcatcgaggccggcacgcgcatgcgcccggccggcccattcgacgtcgccgcgcgcccggctgcaaagatttcaacgggatgtaatccgatgcggcacgtcggcccgcaacgattactgcaggtgccgcgccgcatcgagcatcgcgtcggtcagttcgatcgtcagcgtcaggttttcgtcggtgtcgggcaactgatcgagcgtctgctgcacggcctcgtgcagcatcgcatgcacgcgcgtgcgtgcgccgtcgtcgagatccgcgtaatgctccatcgtgtcgcagtcgagcgcgagcacgaccgaataccgcgccgcctcgggcggcgcctcgagcgcattcgcccacgccgcttggaacatgaccctgcccgtcgcgacgtcgacatgaaccgtcgtgtcgagatcgtccacgtcgaccgcctcgccgtcgatctcgtcgttctccagccaaatccgggaattcgattgcatgatgtcctcctgcgtggtggccgcgcgcccgtcccgggaaaccgcgccgtcatcgcgccgcgcgaccggcttcggatcggttgccggcttcatggcgtgtgctccgtggtgatgacgcggtaacggaaatgcctgctcgtgccgtccggcaacgccgttccagcaatgcccatgccgacgtccgcgctcgcccgcggcgcggcacgcggattgcgtcgcccgtctccgcaggaccatccctcgaccccacacggagccccgtcacatgccttccgcttctgcttcccacgcacacggcaagcgcctcacgcgccgtcccggccgcgcccgcagcgccgatccggcacaccgcaagcgctggtcgggcgaagtcacgcaacgcagcgatgcgctcgacatcgagcccgacatcttcaagtccgacgatccggcggcgatcgccgcgtcgctgaagcgttcggccgaacacagccgccgccgcaaggcgtcgccgttccagtcggcgatgtcgatgctgaacttctacgtgaaccgcgcgggccgcaacctgccgaaaacgcgccgcacgacgctcgaacgcgcgaaacgcaaactgcgcgaggcattcggccgcaagccctgacgggttgcgcgtccgcctttcccgcctgccgcgaacccgcgcatgcacgagacgctctggtacctgatcatcggcgcggtgctgctcggcatgggtgtcgcgacgtcggcgctgcgccacctgccgtgcagcaccgcgatgatctatctcgtgctcggcgtcgcgctcggcccggccggcgccggcctgctgcagctcgacctcgaacgcgacgcgccgttgctgcgtgaaatcgtcgaaatcgcgctgctcgtgtcgctgttcgcgatcgggctgcggctgcgcgtgccgctgaccgaccggctgtggctcgtgccgtgccgcctcggcttgctcgcgatgatcgtcaccgtgccgctgctcgccgcgtgcgcggtgctcgcgctcgggctcggctggggcccggcgctgctgctcgcggcgatcctcgcgccgaccgaccccgtgctcgcgcacgacgtgcaggtgcacgacccgggcgatcgcgacctcgtgcgcttcgcgctgtccggcgaaggcgggttgaacgacggcatcgccttgccgttcgcgctcgcggggctcgcactgtgcggcacgcgcgacgcgacctacgggctcgcgccgctgtccggcgcgttcgcgctcgtcgcgctgtggggcatcgcgggcgcggccgcgatcggcggcgccctcggctgggcgacgacgaaactgatcggctggctgcgcacgcggcacgcgcaggcgctcggcctcgaaggcttcttcgcgctcgcgctgatcgtgctgtcgttcggcgccgcgcagctcgcgcacacgttcggcttcgtcgcgacgttcgcggccggtgtcgcgatgcgccgcgtcgagcaccgtgcgagcggcgaccgcaggccgcgtgaagtgatcggccagatcgattcggaagacgtcgtcgccaccgagaagcatccggagaaggcgcacgcgttcatggccgaatcggtgctcggcttcacgatcgaactcgaacggatcgcggaagccgtcgtgatgacgatggtcggcagcgtgctcgcgacgctgccgggcccgctgctcacgtgggggcggccgcgctggccgccgtgctgttcgtcgtcgtacggccgctcgcggtgctggtcacgctcgccggttcgcgtgcgacgcaggcgcagcgtcggctgatggcctggttcggcattcgcgggatcggctcgttctactacctgctgttcgcgatcgagcacgcgccgtccggcgcggtgcgctcgctggcggcaccggtgctggtcgtcgtatcggcgtcggtgatcgcgcacgggatctccgcgacgccgctgatgaactggtatcaccggctgcagcaccggcgctgacgggttcacgtttgcgccccgagccgcgcacgcatcgacgccgtgatgcgctggcgcgtgtgcgcatagccttcccacgggtcgcgtttcagcgcgtcgagccgatcgcgcagcgtgtcgatcgtccattgcgcgccgcccgtcgtagcgggcacctcgtcccattcgagcggcaccgacacgcccatgccgggccgcgcacgcagcgagtacgcggcgatcgtgctcgcgccgcggccgttgcgcaggtagtcgacgaagatcctgccgcgccggtggcgcggccccatcgtcgcggtgaagcgctcgggcagcgtagcggcgacgtgctgcgcgaccgcgcgggagaagtccttcacgtcgtcccagcccgcatgccgcgtgagcggcacgacgacatgcagccccttgccgccgctcgtcttgcagaacgacacgagccccagttcgtcgagcagcccgcgcacgatctgcgcggcgtcgatcatcgcgcgccacggcagcgccggatcgggatcgaggtcgaacacgatccggtcgggccgctcgatgttcgacgcgtgcgcgttccacgtgtgcagctcgatcgtgcccatctgcgcggcgccgagcagcgcgtcgacgctgtcgatcgacagcagcgggccgtggccgggatcgagtccctcgtgctgcctgacgaacgggatttcccggcgttccgcatgcttctggaagaacagttcgccggcgatgtcgcccggcgcgcgcacgagcgacacgggccggcctttcaggtcggggagcagccacggcgcgacccataaccagtaatgcgcgaggtcgatcttgcgcgtgccgctgcgcgggtcgagcacgcgatcgggatgcgtgatgcgcacgcggccgacgtgatcgacgccgggttcgccgggcgcgcggccggcggacgcatgcgttcgcgcgcgcggccggcggtcgtgcccggtatcggtatgcggtgcatgcgggtggttgtcatgcgctgcctggggttcgtccatcgtcgtctccgattcggtatggctcggcacctcgcggacgatctgccgcgccggcttgtcttcgcgcagcgcgacgaacgacgcctgccgcacgatcccgtcgcccgtccattccgcgaattcgcattcggcgacgagcgtcggctcgacccagtgcacgcgcgtgcgcgaccgttcgcgcggcggcgggtcgaacggcgtcgtgtcgcgctcgtgcttgcgcagcatggccgcgagccggtcgagcaggcgcgtgtcgaacccggtgccgacgcggccgacatagcgcaacggcggcgtgccgcgtgaccgcttgccgcccgcgtccccgcatggacgccgagcagcagcgcgccgaagccgtgccggctgcctgccggctcggtgtagccgccgatcacgaactcctgccgccgccggcatttcagcttgatccaggcgggcgagcggccgccgcgataacgcgactccgcgcgcttgccgatcaacccttcgagccccgtgtcgcacgcgtgcgcgatcagcggcatgacgtcgtcgccgagatccggtgaaaaacgcagccgggccgggtcgctgccggcgagcagcggctcgagcagcgcgcgacgcgcggcgagcggcacgtcgcgcaggtcgtatccgtcgagaaacggcaggtcgaacacgaacagcgtcaccgcgtccgagcggcccgcgccgagcgcgttctgcagcgcctggaaatcgggcaggccgttctcgccgagcacaacggcctcgccgtcgagccatgcgttgtcgacctcgagcgcggcgagcgcatcacgctgcgcacgcagcttcgcggtccagtcgcggccttcgcgcgtcatcagtgtgacgtgccgccgcgcgccgcgaccggcgatccgcgcgaggatccggtaaccgtcgaatttcacttcgtagcgccagtcgccgtgcgcaggcggcgcatcgaccagcgtcgcgagttgcggcgcgatgcgctcgggcaacgccgcgtgcacggcgccgtccacgcgagacaggtcggtcgacgggctgcccgcgtcgccgtcgtgcgtgcccggcgcgttgccgtggccgcgccgcgcggcacgcgcaggggcggcacggcgccgttccccttccgcgcgcggcctgcgtgtgcccgtcatgcacgctgcccggccgctgcgcgacgacatcgaacgccgccgcatcgcgcgcgtcgtcgtcgcgctccttgatcagcagccattgctcctggcgcccctgctgccgcccgctgcgcaccagcgcccagccgccgtgcagcttcgcgccgtcgagccggaacgtcagcttgccggcacgatagcccgcgcgtgcctgcgcgacgccgccgtcgggcgtccacgttccttcgtcccacacgacgaccgagcccgcaccgtaatgtccggccggaatctcgccttcgaacgacgcgtattcgagcggatggtcctcgacatgcacggccagccgtttcaccgccggatcgacgctcggccctttcggcacggcccacgatttcagcgtgccgtcgagttcgagacggaagtcgtagtgcagccgcctcgcgtggtgctcctggatcacgaagcgcaacggccgggccgtgcgcgcggacgttcccgccttccgcgactgccgcgcgtccgcgtcggcgggcgcgcgccgccgcccgtgcgcgccctcgggttccggcgtcgcgtcgaagcggcgtttgcggcgataggggtcgagtttcgcggccatcgcgtcgttctccgttgcgtgatcatgcggcgtgcttgcggcgcgcggcgatcttcttcgccggatgcgccacggccgtgccgtgcttcgcggccgcgcgtttcgcgggcgccttcgcggtgccctttctgcacccttcgcggcagccttcgcagcccccttcgcacccctttcgccggcgctttcgcagccggtttgcgccgcgcaccggcggcacgcgacgatgccggcgccccggcacctcctcgtcgcccgcatcggctgcccgcgcaccgccgcccttcaggctgcgcttcagcaactcggtcaggtcgaccacgttggacgccgcgcgccccgtctgcgcgggcctgtcctcgatctcctcgatccggcccgcgcgcaccttgcgttcgaccaggtcaaggatgtcgtcgcgaaacgtgtcgtgatactcgtcgggtgtccacgaacccgacatgtcgtcgatcagcttcttcgccatcgcgagttcgcgcgcactgacgcccgcgcgcttcgcatcgccggccggcaccgacagttcgtcgagcgggcgcagctcctcctgccagcgcagcgtatcgagcgcgagcagcggcccgaccggaatcagcgcgcccagatgctgacgatcgcgcatcacgacgtgcgcgatgccgatcttgccgctgtccttcagcgcgtcgcgcagcagcgcatagaccttttcgcccttgcggtccggcacgaggtagtacggcgtgtcgagatacaggaacgacacggcgccttcgtcgacgaacgtgacgatgtcgaccgtctgcgtcgattcggggttcgccgcgcggatctcgtcgtcggtcagcacgacatagcgctccttctcgtactcgtagccgcgcacgatgtcctcgcgcgtgacttcccggccggtgcgcttgttgatctgccgatagccgaccgggtccatcgagcgcctgtcgagcaggcggaacgacggcttcaccgtacgcgtggccgggaacagctgcacgggcacgtgaacgagcccgaagctgatcgcgcctttccagatcatccgtgccatcgatgccctccttgcggcgtgtgtggtccggcgaaagtcacggcctgcggcagcggctgcgccgcacgatgctgacgtggccgttgcgctccaggatcgccgcgtcgacgtcggacaggtcggtcgcgccgagcgcctgccgcacgctttcgcggatgtcggtcggcgtgagcagcgcggcgcgcatctgcgcgtcgtcgaagcggccgttgcgatacacctcgcgctcgacgcccaccagcaaccgctcgagccggcgcgagcgcacgcaggcccagccgatcgcgcgatgcagcagcgcgatcgcgaacgacgccgcgacggtcgccacgaacggcgacgcaccgaccaccgcgcggctcaggatcgcgccgagcaggatcccgaccacgtagtcgaacggcgaacgctggccgaatgcgcgccgcccggcgatgcggatcagcacgagcgcgaccagggacacgacgatcgcgcgcagcgccatctgcccggggccgagcatccggccctgtccgaacagcgcgacgacgatgtccatgatcgcgcggcgctaggccggcaactcggcggcctgctgctcgcgcgcccacacgcgatggcagccgaggtggtcggacagcgtattcaggatcgcgtcgagatcgacggtctgcccgacgcacacgccttcggccgggtccggcagatgcgcggcgctcagcagttgccgccccgacccgacggccgcgatcggcttcaggtgcttgaacgcctcgcgcacgaagtgccgcgcgtcggcgctgtgcgcaaggtcgcggccatcgccgtcgccgccgcacacgaacaccgcgtcgaacatcaccgacggcatcccggccagcgtcgcctgcggcacgatgctgccgatcggcgcgagcgtcggcgcaacgatcgtcggcaccgcatgcgcggcctgcagcgcgtcgcgcacttgctcgacgagcgcctggctcgcacccggcgtcgcgatcagcgcaatcttgcgcgagcggatgccgggcttcgagcgcccgatcaggctcagcgcgggcgagcgctgcgccacggcaggcgtcgcacccggatgcggtgcgggcagcccgagccgttcggcgacctgcgcggccagccccgcgtcgaagcgcgcgatgatgtcgttgaccacgcgctcgcgaatccgcggctgcgtcaccttgcccagctcgaagcagtacgcgtcgcggatatgccgttgctcgatctccgtcatgctctggtagaacagcgcggcctgcgagaaatgatcggcgaacgattcgcttcgcacgcgcaccttctcgccttcgagcggctcgtgcacggtctcgaagccgccgcccgacggcgccggcggggtctcgcgcggccagccgccgctcgtcgaattcggctcgtaggacgcctgcccgacgttgatcgtctgccggtgcatcgcatcgcgctggttgttcgcgaacgggcacaccggccggttgatcgggatctcgtggaagttcgggccgccgagccggctcagctgcgtatcggtgtacgagaacaggcgcccctgcaacaacggatcgttcgtgaaatcgatgcccggcaccacatggcccgggtgaaacgcgacctgctcggtttccgcgaagaagttgtcgggattgcggttcagcgtcatccggccgatcggccgcaccggcacgcgctcttccggcacgagcttggtcgggtcgagcaggtcgaagtcgaaccggcccgcatcggccggatcgatcatctgcacgccgagctcgaactccggatagtcgccgcgctcgatcgccatccacaggtcacgccggttgaaatccggatcgtggccggcaatccgctgcgcctcgtcccacagcagcgaatacgcgccgctcacgggccgccagtggaatttcacgaaacgctcggcgccgtccgcgttcacgaagcggaacgtatgcacgccgaagccgtccatcgcgcgaaagctcgcgggcagcgcgcggtccgacatcagccacagcaccatgtgggtggcctccggcaccagcgacacgaaatcccagaacgtgtcgtgcgcggacgcgccggtcggcatctcgttcggtgcctcgggcttcaccgcatgcacgaagtcgggaaacttgatcgcgtcctggatgaagaacaccggcatgttgttgccgacgaggtcgtagttgccctcttccgtatagaacttcaccgcgaagccgcgtacgtcgcgcaccgtgtccgccgaaccgcgcgggccctgcaccgtcgagaagcgcacgtacaccggcgtttcggcggccgggtcctgcaggaacgcggccttcgtatagtcggccatcggttcgtagacgcggaacacgccatgcgcggccgagccgcgcgcgtgcaccacgcgctccggaatgcgctcgtgatcgaaatgcgtgatcttctcgcgcatgatgaagtcttcgagcagcgacgggccgcgcgtaccgccgcgcagcgtgttctggttgtcggcgatccgcacgccctggttggtgcgcaacgcttcgtggtcgggccgcgaacggtgttcgtcgagctggcgcgacttcgcgctgtcggtcgactgcgcgggcgcggtcctgccggctgatgtggaacgggtcatcgaaaggtcctcgtggcattcgggtgggcagccgccacgcaaaccgccgcgccgcggcgcgggcatgctgacggcagcgaaaaccggtacgacgggccgcgatcgcgcccgcgatgccggccgtgaaatcagggcgcggccagcgccgcgtcgaattcggcgcgcgtcacgtcgagcgtcacgctgcattcgatcgcggcatcctcgacgcgcggcttgcgctcgtccaccgcgcgccgcgcgcggtcgcacaactgcgtgcgcacgcgcagccggtcgtccgcgtcgagcaaaacgtagcgatcgacgacgtcgggatcgaaccgcaggtcgaccgcgcaacgccattcgcgcgcgtcctcgtcggacggcacgcgcacccacgacacctggatcgtcaggccgccggatgcgtcgtccgcgtgcacgacgatggtcgactgcgacggaaagccgatcgcgagcgcgtgttcgagttcggccacgcgctgcgaccggtcgggcgcggcactcatcgtcgcacgacgcccagcagcagcgtgaccaggaagatcacgacgaagatgtagaacaggatcttcgcgatctcggccgcgccggccgcaatcccgccgaagccgaacacggcggcgacgatcgcgatgatgaagaagatgatggcgtatcgaagcatggaaccctcctggatgacagcggtcgtcaccaaacgtcgtcgtcggtcacgcatcgtgcttgtgtttcggtttgccgcgcacgggcgtggaagccattttctcgagctctttctcgctcatcgactcggccatcgacttcgccggcggtttgaggtccttcatcttcgtttcaccgcgcttcgccgacagcgccgcgcctgcggcacgctgctgcgcctgggattttgctggcatggttgcactcctgtcgtggatggatgcgcgggccgacacgacgggcggcgccgcgcgcggttgaaaatcggttcggcgggcaagccgtcacgtcacgcggcatcgcgacgccgcaggtcggccgccggaatcttcatcgcctgccgatacttcgtcaccgtacgacgcgcaagaagaatgccgcggcccgcgaggttctccgtgagcgcgacgtcggacagcggctcggtttgccgctcggccgcgatcatgtcgcggatcagcaccttcgccgccgacgccgagcacacgcccttgccggccgcctcgagcttgcgcgggaagaaatgcttgaactcgaacgtgccgtgcggcgtggccatgtacttgttgcccgtcgcgcgcgacacggtcgattcatgcaggtcgagctcttccgcgatgtcgcgcagcacgagcggcttcatcgcgatctcgccgtaacgaaagaaatcgcgttgccgcgcgacgatgcattcgcccacgcgctggatggtgtcgaagcgcttctgcacgttgcggatcagccagcgcgcttcctgaagctgctggccgagcggcgaatcgcgctcgccgctcgactgcgcgaacagcgtcgcgtagcgctcgtgcaggcgcgcgcggcagcacggccgggttgatcgtcacgatccattcgtcgcgtacctggcgcacgatcacgtcgggcaccacgtagtcgccgcgcgtgctgccgtagtgactgccggggcgcgggtcgagcccgcgcaccagcgcgcaggcggcgtgcatcgtctgcgggttgcagccgagacgccgctggatctccgccgtctcgcggcgggcgagccgttcgagatgctcgcgcgcgatcgccttcgcttccgcgagcgccggcgtaccggccggaatcgcgtcgagctgcagcacgagacattcggacagcgaacgcgccgcgatcccagggcggtcgagcatctgcacgagccgcagcgcgatcgcgagatcctgctccgacagcagcagcgccggatcggccgcgacccgcagctcggcgaactcctggcgcagatagccgtcgtcgtcgagcgcgtcgatcacgatgcgcgcggcttcgcgatcgcgcctgttcaacggatacagcctgagcgcgtcgtgcagctgctgatgcagcgacggttcggcggcgatccattcgcccggcgacaggccgtccgcatcgtcgccctggcggttcgtgccgcgcggcgcgggcgccgccgtcagcggcacctcgccgtcgggcggccggacatcctcgggctcgggcgccgcttcgggcgcgaccgcttccgccggctgctccggcgcgccgtcggcggcttcctcgtcgcccgggccgtcttcgagaaacgggttcatgtcgagcgcctgccgcaattcctgttgaaattcgagcgaggacaactgcagcagccgcagcgactgctgaagcctcggcgtaagtgccagatgctgtcgcatctgcaacgcaagcgagacgggcatcgaaagcctcctgattattcggttcgcgttaggtcgtctgcacgacttacgcagctttcgtgccaattcggcgaagcgcgtcgcctcgcagttctcgcgggttcgcaccctgcttggacgctggccggggccgctttttacaagcccgcggcaagttttggggcacgccattcgctcgtccggaagggcatccggatgtgcccccgaacgccgccacctgccgtacgtgatgcgtggaaaacgctcgatcagtactgcatcggcggcggcgtgcccggcaacggccggtcgccctgcgcaccgttcggccccggcggcgggacgtcggccggttcgccgccagccgcgccctgcggcatcatgttgcccggcgacggacgcgtgtcgtagcgcgtattcgcgtccggcatcgtcgtggtcgactgcgcgccgcggccatccggcggtgcgggcggcgccccgtgcgcaccgtaggggccgttcgtcggttgcgtgcaggcagcgagcgcgcacacggcggcgaacgcaagggcgcccgcgcgtatcgtctggatcgtgttcatcgaatacctccgttggatcgatggctcagagccggttgaaatggaaatcgccggcataggcggtcggcgtgcggcgcgccatcatcgtgtcgaattcggccgcgacacgcgcgagcgtgccgcgctgcctttcgatgccggcccgctcgagcgcggcgaatgcgtcggcgtcgaacgacaccgacagcgacgccggatggccgtcgacgcgaaagccgatatgcaacgcaccggccggccgctcctcgatgtggaacggcatcgcgcgcgcttcgaaatggcggccgagcgtctcggcgatctcgcgcagcacgccgggtttcacgcggacgctcatcgccgcgcctgcgcatgcagtcgccctgtcccgccgaccgacggcgcatgcacgggcggctgccgcgacggcggttcgcgctcgggcggcgcggtcccgggcggatcgcctgccggttgccggtgcggttcgggcacgtcgggcggcaagtcgtcgggatcggggtcgtcgggatccggctcgaggtcggggaacggcgggatgggccgctgcagccattgggcgggatcgtgtttcatcggcattccatcggggcgggttcggatcggcatcgtgtgcggcggtcgtgactggatacggaagtcccgcaatgcgcatgccgtccggtcgcgacgcccgcatgcgggcgccggcgcgaacacgcgcggccccatgcgacgcgtcgtgccttcgctacaccgctcgctgcaaatctttcaagcacgtcgttatgcgtcgtacgcggccatcacgagccacagctcgcggccgttgtccttcacgcacgccgccagcgcatacgaatcggacggctcgcacgcgcgcagcgcgaaacgcgccggttcggtcgaaccgaacgtctcgtcgcccaacggccgcacgtcggccttgccctcgaacatccggcgctcgggccggtagatcagcggttcgtgtttccattcgttgaaatggctcttcaccgaatcgaatccgccgccgcatacgttgatctcataacgcacgcctggtcgtcgtttcggaatcgtcatcgtgcctccgctcgaaatgcgcacggcaggcaccggtcgggccgcgcgtcgtcatcgcagtcgatacggcaagtcgtgtgccgcgtccgcgagccgggcacggccgttgcggcaagcccggctcctcgtcaccgatacggagcctcgcgatgaaggattcgacccggcccggccacgacgcgccggcccacgagcggcatcccgacccgacgccgccgctgaagcaccaggaccgcacgcgcacgcgccattcggaacgccatatcgacaagcagctcgaggatacgtttccggcaagcgacccgccggcgaccggcggcgtcacgcggatcgagccggacacgccgcccggcacgcacgacgaagggccgtggcggagcccgcgcgaacgcgacgacggcgcgtgacgtacccaagcgaaccgcgcgtgcaggaaggcacgcggcttgcggactccaccgacgaattcgccatccccacctgcaaggaggaagtcatgcatcgcgtcaacgaaatcatgtcgcaggacgtcgtgcgcatcgcgccgaccgactcgatccgtcatgccgcgcaactgatggagcgctacgacatcggcgcgctgcccgtgtgcgacaacaaccggctgatcgggatggtgacggaccgcgatctcgcggtgcgcgcgatctcggccggcaagccgccggaaacgcgggtccacgaagtcgcatcgggcccgatcgaatggtgcttcgacgacgattcgctcgacgagatccagcactacatggcggacgcgcagctgcgccgcctgcccgtcgtcgatcacgacaaacgactggtcggcatgctgtcgctcgcggacatcgcgacgcgttcggccggcccggcgcgcgacgacgtcgcgaacacgctcgaaggcgtgtcgcaaccgaagcagacgtgacggcgcgatccttgcgccgcacgatacccgcgcgacccgcagggcccgccccgggcaccgtcgcgccccatgcagcctggaggaaaccatgcacacttccgatcaaggtcagacccgcatcatcggcaagggcgccgcaacggcagccggccccggccccgacgtgatggcggccgatacgctggaaggcgacaaggtctatacgaccgacggcgacgacgtcggcaagatcaaggacatcatgctcgacgtgcgctcaggccgcgtcgcctacgcggtgctgtcgagcggcggcatcctcggcatcggcgacaagctgcacgccattccgtggagcgcgctcacgctcgacaccgaacgcaaatgcttcctgctgtcggtgtcgtccgagcgcatccgcaacgcgccggggttcgacaaggatcactggccggcgatggccgatccgcaatgggccgagccgctgcacgagttctacggcagcgcgccgtactggagcggcggcgacgaactcgggctgaccgacccgaccgaggaactgaacgatccgcgcgcgcgaccgtcactgatcgcgcgacgatgcggcaccggttcgccggcgccatccgctttcctttctacacgccgctcgcgcggggcgtctttttgcaagcggggacagcggaaggtgaggtgcgttgcgtgcgttcagtgcgctacggcaccgctccgatcgcgctggagaacacgcgcgatgccgggcggcggccggatcgtcgccggggtccggttgcatcgcgcttccctttttcctgtcgccggaaccgatcgccgtgcagctcgcgccggccatcatcgggcgccgcaaccgggagcggcaacgccccggctgcggccccgttgccgtcacatcatcttgccgcgcgagcgctcggcacgcgccgcctccgccgccgattcgaccttcttcacttcctccggcggcggcagcacggccttgaagcccatcgactcgatccacatctcgcgcgcccagccgcgcgtgtgatacaggtggtgatcctcgtcggcctcgacctcgtcgtgcgcgtccttcaatgtcttcgccgcgtcgcccgacaactggtcggccgcgtagccgatcagctcccagttcaggtggtccttggtctcggcgagcaccacgcactccgccgcgacgacctgcgcgacggccggatcggcgtgcttctgcgcctgctcgatcacgtggaccagcgccttgccggtggccgcgaccgcgctgcgtccgggcgactgcgcatcggggtccatgcctaacgtctcgaacaccttgcgcagcacttcctggtgatgcagcgtctcgcggtggtacttctcccattccttgtgcagatcgccgtcggtcgcgcactgcagcgcggcctcgtagagcttcgcgccgccaagctcggtttcgtatgcctgacagagcaattcgcggatgccttcgtgtttcggttgccgatgggccatgactgcctctccgaaaaacgggccgcgcgcggccgggatgaacgggcacgcgtcaccgcgcgcccaccttgcgttcgagcgcctgcgccatgctcaggtgatgcctgagcgtcggcagcgtggcgctcgcgaattcgcgcagctgtgggtccctgccgtcgcgcgcctcgccttcgaacagcgcgacggccttgcggtgtgcgtcggggccgaccgccgcgacatacgcgacgtcgaagtcgcggccgttcttgccgcgcagcgcctcgacgtcggggtccgaaatctgttcgacctgcggcttcatgcccttgcgcgcggcgagctcggtgagccgcgcgttcgccttgccgtggtcgttcaccatctgcttcgcgaagccgcgcacgtccggcgacgccgcctgcttcaatgcaagctggctggcctgcacctcgaccttgccggcgatcgcggccttgtcgatgaattccgcgtcaccgccttgcggcgccttcgcgatccgcgcgtcgcccgcgcccgacgacggattgatcacgccgcccggcacatgcgaattcgatgcgggcggctcgctgggcgcctgcgcgccggcgagccccgatacggcgagcacgcccgcagcaagcgccgcgatcgtccagttcggatgtttcatctgccttctccttgcacttgcgtggaagcggccgccgatgcccaccgacggccaccgatcgccttcagccgccgacgatcgagccgccgttcgggtgcagcgtctgccccgtcatgacgctcgcgccgtcggccacgggcgcggcctcgccggcgagcctgccgctgcccacgtcaccggccgcgtcgtcgtgcggcttcgtccggccggcgcaccggatcgaaatcgcgccacttgccgtcctgccagtcgccgtcgacgcgctcgatcgacttcgcgcccgtcgcacgcagcacgtcttccgccgtggcggccgtgtccggcgtcacatgcgcggcgaggatcacgcccgtctcgcttcgtgcaagcgtgcccttgccttcgtcctgctcgccgcgcatccggccgagcgcaccgcccagcgcgccgaggtacgcaccggccagtgcgcccgccgccggcacgaaccagtagcgcacgcccaccgcatagacggccaccccgacaacggcgccgatcagcaacccgcgcatcgcgccgaccatcgcgccgcgcccgccgggtttcgccgccgtgtcggcgtagacgtcgccgccgatcggaaagcgcgcatgctggccgcccgggttcaggaagaaaatcgacacgtcgtccgtgccgaacgcgcgctcgtaaaggctgcgcgccccgctctcggcttcatcgaacgtcgtgaagcggcctgcgacgatcatcgccatgctcgtgctccttgtcgcggtacgccgcgcgcgagcgcgcacggcacgatggcggcacggctcacatcagccgcccgagctccttcgacaccgatgccggcgtgtcgtattcgcgatcgggaatgcgcgtgagcatgtcgagcacgtcgtgggccgcatgcgagcgttgcgcgcattcgacgatggtcgccttgctggccgggtagtccatccccttcagcgccttctgcacgtcgaccgggctcggcggcttgccgtggccggtctggtgcccgcccttgtcgtggtcctgctgcgcgcgctcgccttcgtgcgcgcgggcacggctgagttcgtggcccgtgtgttgtcgggatgtcatcgaaacctccttgatcgagtgaacggaaacggcatcacgcgggcccgcggcgcgcacgcgcgagcgcggcgaacacgagcgccgccgcgccgagcgcgaccgcgccggccatcttcggccgctgcaccaccgtgttgtaggcgcagctgcgcagcacggggccgtccatcccttcgcgctcgtgcagcgcatgacgcgagtcgtacagcgcgttgtcgtcgcgcgggcgcgcgggccgcaccgtgcgctggccgcgcgagaacagcgtggccgcaacgcgatcgaacaggcgcggcgcgtggtacgcgctcgccgacgtgaatttcgcggcaccgccgacgaacagcgtgcggcgcggatgggcggccgcgaacaggatcgcgtcggccacgaggtcggggtcgtagatcggcggcggcagcctcggctcgacgttcatgtagttcttcgcgtgcatcacgaacatcgtgtcgatcgcggccggcttgatcagcgtgactgacaccggcaggtggtccgattccatctcgagccgcagcgaatcggtgaagcccttcacagcgtgcttcgacgcggcgtacgcgctttgcagcggcaccggcgcatcggatgcctcgctgcccatgttgacgatcgcgccgccgtggaaatcgcgcttgcggcggaagtgatcggccgcgacgagcgagccgtgcacgacgccccagtagttggtctcgaacaggcggcgctgatcctcgagcggcaccgcggccgccgtgccgaagatcgacacgcccgcgttgttgacccaggtgtcgaagccgccgtaggtgtccgccgccttcgcggccgcgcgctgcacgtcctcgaggttcgcgacgtcgccggcgaccggcaccgcgaggccgccgtgctggctgatttcctcgcacaacgtgttcagcgcgccctcgttgcgcgcgaacagcacgagcttcgcgccgcgccgtgcggccttgcgcgcggtgacgagaccgatgccgctcgtcgcgccggtgatcacgatcgtctgctcgccgaccggtttgagcatgcagttcatgacggaactcctgtagcggcaacgttacttggcccggatggtcagttggtcgcgcacgtcctgcacgccgtccacctgcttcacgacgccgacggcctgcgtgcgctgctgttcgtcgggcacgctgccggtgagcatcacgatgccgtgccgcgtcttcacgtggatgtcgccggacgacaggccgctcgtgccgacgagctcggccttcaccttggtcgtgatcgtcgcgtcgcggatcttcctgccggccgtcgaatgcgacgacgtggatgacgtcgacgatgtggacgacgacgcggcgctgtcgtcgccggcggcgaacacgtccggcacggccgtgacgcaggcggtcgccgcgacgatcgcgatcgccatgccgacacgcttcgcgcgatggcggcggacgtgcaggagcgggcttgcagctggaataccttcatcgtgacctcctttcgtcgagccggcacggccggcgggcggacatcacgggcgcaaaccgcgtgccgcggccgcgccgcccggtgctggcggcaatcgccggccggacgcgctttcatccaatgcgttgtaatttttcgacatgacggccggcggtttccccgcagcggtgcgggtatgccgcttgccgaccggcggctgcgtcggcccgtttgcgcgggccggacctcggggcatcgcccggcgaggaggcgcgtcgatcagtgaacacgtatcgcggttgcggggagccggcggtgtggacgcgggcgggaggattcaagttgcggacgttgcgaagcaatccgtggagcgcgacatcggccacgatgcccgtggcgaactcgcgcacggcaacgtaaacattcaatggaggactgcgagataaaacgcgggttcgtcgacggcagcgccatctttcccggttcacattcgtgcgagaggcacgtgactaccggcgccctcgacgtcaagcaaccgcggccagcgcgtcagtcgtctcgcttcgtcgcgtgcgcgatcttgtgcaccagttcgcgcacgtcgaccggcttgcacaaatagccgtcgaacccggcctccagcgcacggcgctggtcggcgaggccggcatgcgcggtgaccgcgagcacgcaaacgtcgggcggcccgctgtcgccgttcatcgccccgtgccgcaacgcatcgagcagccagaagccgtcgccgtcgggcatcgcgagatcggacagcacgacggtcggccgcaagtcggcggccacagcgagcgcctcgcggcccgacgacgcgatcgcgaccgacgcgccgaacgtggtcagcgcggccgtgaggctcgcccgcgtcgtcgcatcgtcgtcgacgatcaggatccgctgcgcatcgagcacgagcggctcgcgctgcccgcccgcctgcgcgagcccccacgccatcgcgccgaccggctgccagccggccggcagcgtcaccgtgaacgtcgtgccgcgattgcggcccgcgctcacgacggtcacgcggccgccgtgcaactcggcgatatgccgcacgatcgacaggccgagaccgaggccgcgtcgcgacgacgcaggcgaatcgtccgcgcggcgaaacatgtcgaagacgtacggcaggaactcctgcgcgacaccctgccccgtatcggtcacggtcaggatcacccgcgcgttgtcgcgcgcgagcccgaccgtcacgttgccgccgtccggcgtgaacttcagcgcgttcgagatgaggttcgacaacatctgccgcaaccgctcggcgtcacccgacacaatgcacgacgaggtctcgcaatcgaattcgagctcgatgccggccaatgacgcggccgtctggaacgcgccgaccgaatcggagaacagccgcacgatgtcgaccggcgtcgcgtcgaggcgcagcttgccggtcgcgagcgacgacgcatcgagaatgtcgccgaccatccgcgtgagcgaacgcgcgctgcggtcgatggcatcgatcgcctggttctgcagcgcctggtcgccggaattgcgcagcacctcgacccagccgtagatcacgttcagcggtgtgcgcaactcgtgcgataccgtcgccagcagctcgtccttcagccggttcgacgtatcggcctggtcgcgtgcgtcgcgcgcgcccgcagcgagcgctgcgcgcggaggtcgcgccggcgctgcgcaccggtttcgcgcagcgtcagcgacagcgcgacgcattcgcgtgcctcgccgcgtaccgggcacgccgacacggtcgcgcgaaaacgtcggccgtcgcgccgcacgcacagcagttcgagcggcccgaccgggtcgcgcatcgcttcgaaggattcggccagcggattgcgccgcaaccagcgcatggcgatcagcgagtcgaacatgcggccgcgcgcgtcggcctcgtcgtaaccgaagattcgctgcgcggccggattccagctggcaatgcggccgttcgcgtcgatgccgacgattgcgtccggcgatgcgtcgaccaccgcgcgttgcaagcgcgacgcgtcgacgcgtgcgcgatccgcgccggcatcgcgcagcagcagcaccgcgccgtcgagattgccgtccggatcgccgagcggcgcggcaacctcgacgatcggcaccggatcgccggtgccgtcacgctgcagccagtgccggtcggacaccgcgtccgcgccgtcgagcgcgcgatcgagcggcgtcgtctgcacgcggcggccgtcacgatcgacgatccgcagcacgtcgcgcaccggccgccccgccgcgtcgccaggccggcagccggcgagttcgaccgccgccgcgttgatataggtcagccgccctttcgtgtcgaccgcgatcacgccgtgcggcagcgcactcagcacggcttcgagctgccggcgtaaagccgcctcgtggcggcgcgcgcgatcgttcgtgatccgtgtctgtcgcaacatagacgcgatcgcgcaaacgagcgcaccgatcaggatgaaggtgccgagctgcacgagccgctctggcagcggcgccggataggcggccggatcggacaggaacagggtccacacgagcagcccgctgacgacggtcgacacgatcccgaacaggaacgacgtcgcccacgcggcgcctgcgagcagcgggtagtacatcacgaacggcaggttcacgccgccgaagcggatcgcgagcacctgcagcacggtcgcgatcgcgaccagcatcgcggccgtcgcgtagtttccggcctgccgccggggaagatcgatcatcggacacgctcctgcggggccggccgacggccgcgaccccggacaccgccgaccggcacgacgcgcgacggccggccggaaccggccgcgcagccgcccgccacgggatgattcacgcgacggccgagccggcgcgcgggctcgtcccgccgcatcccggcgatgccgtcgccggttgcgcacgcgtgatgcgaaaacgggagcatgagtgtgatcgcgacggcatcaggagtccggcttctccgtttcgtcttccagttgcgcgagccggttgtagatcgttttcaggctgacgtcgagcacttcggccgcctgcgccttcacgccgccgcactgcgcgatcgtgccgaggatcagcttgcggtcgacttcctcgagcggcgtgccgaacggcaccgtcacgcgatcctcgtgcgaatcgaccatgctggacagttcctccatgatcggcggcggcagcgtgtcgatcacgtcggcgtcggtaaagatgctcgcgcgctgcacgaagttgcgcagttcgcgtacattgccgggccattcgtaggtcttcagcgcctcgcgcgcggccggcgcaaagcgcaggttgcggccgctttcctcgttgtagtgctgcaggaacgcatcggcgagcatcgggatgtcgtcgccgcgctcgcgcagcgacggcagcggaatcggaaacacgttgatccggtgaaacaggtcgggccgcagctttccgtcggccatcgcggcttccggatcgcggttcgtcgcggcgacgatgcgcacgtcgacgtcgatctcgcgcgtcgagccgagccgcgtgaggcgccccgtctcgagcacgcgcagcagcttcacctgcgattcgagcggcatctcggtgatctcgtcgagaaacagcgtgccgccgtccgcgcgttcgaagaagcccttgtgctggcgctccgcgccggtaaagctgccgcggtcgtggccgaacatctcgctctcgacgaggttcgcggcgatcgcaccgcagttcaccgcgaggaacgggccgcggcggcgcaagctcaggtcgtgcacggtctgcgcggcaagctccttgccggtgcccgattcgccggtgagcaacaccgacgcttcggtgcgcgcgacgcgcccgatcgcatcgtagacggcctgcatcgcgggcgagctgccgagcatgcggccgaatcggccgaggcgctgcagttccgagcgcagctccgcaatttcctcgtgcagcgcggtcgtgcgcggcacgcgcgcgaagatgctgttcagccgctgcatgttcagcggcttcaccagatagtcggtcgcgccgcgccgcaatgcgtcgatcgcggtttcgaggctcgcatggccggtggtcagcaccatctcgcaatgcgcgcgcttgggcaacgcgtcgaacaagtccatcccgttgccgtcgggcagtacgagatcgcacagcacgagatcgggggtatgcgtcgacacgagcgcgcgtgcttcctccagcgtcgcggcggtatcgcaggcgagttgctgcgttcgcgcgagcgtcgccagcatcgtgcgcgtatcggcatcgtcttcgacgatcaggacgtagggcatcgaagctcctcgtgatgcgagccggtgcaagtgtcgaccggacatcgcgacagatgtgcagcgcatcgcacgccgccaggcacgaggcaatgcattccacgctgcagcgaatgaactggcaggccatgctgccatgacgaaggaatcgcttagcagtatagaagagcgacgtcgcgcatcggcccttcatcgaataaatctatccgcccgcgcggcatgcattgcgagattcaatgcggccgcggcgacataacacgtatgctttgcgcatgaataacggcgcataacgtgtcgtttttcgtgtgcctgggtcatagtcggtcaaatcttccccattcgatatcacgtcatgtcgaaatccgtcgatgacggcaagcgtctgtcgggacgctcgcgttcgatccagaccctgttgatgaaggtgtcgcgcgtggccgcgacgcgcatcagcgtattgatcgtcggagaaagcggcgcgggcaaggacatcgtcgcgcggctgttgcacgacttgagcccgcgccggcgcgggccattcgtccccgtgaactgcggcgcgatcccgcccgatatcgcggagtcgcagttgttcgggcacgagaaaggcagcttcaccggcgcgatcgcccagcatgtcggcatgttcgaagccgctcgcggcggcacgctgtttctcgacgaaatcgccgagatgccggccgaactgcaggtcaagctgctgcgcacgctcgaatcgaacacgatcgtccgcgtcggcggtcacgagccgattccgctcgacgtgcgcatcgtcgcggccacccatcacgatcccgtcgaggccgtgcgcagcggccggctgcgcgaggacctgttctaccggatcgcgccggtcgcgctgcacgtgcccgcgctcaggcagcgcgaggacgacgtcgacgacatcgcgctgcagatcgtcgagcggctgaatgcgcggcaccgcacgcgcaagcggctgtcgatgcaggcgatgaaggcgctgcgcgcgtattcgtggcccggcaacgtgcgcgagctgcgcaatgcgctcgagcgcgccttcatcctcgccgacgagcagatcgacctgcagttgccgcgccggctgcagccgcgcgacgacgtgcgccacaacgcgatgacgctgcatttcggcacgacgctcgcgcatacgcagcagcgtttcatcgtcgcgtcgctgcggcatttcaacggcgacaagccgcgcaccgcgaaagcgctcggcatcagcctgaagacgctgtacaaccgtctcgcgctgctgcccgagcatgaacgcaatgcggcgaacggcggcgccgcgacgaacgccgccgggtccgcgaatgcaaccggcgcgaccggcacgagcgatacgaccagcccgtcgaacgcgacgcccccgtaaacgcggcccgtcgcgctgccacgtcgtcgcaccgtacgcgacccggccgcgcgtgaaccgatcaataccggaacacgcgcccgcgtcgggccgccgcgggctgtcgtcatgcacacgccgcccgcggtcgcgccgtttcgtgcacggccggtcaatgatgcggcttgcgctcgcggtcgcgttcggcggtgccgggttcgggatcgcgcgcggccggcagcgtcggcgtgacggttcgctggtcgggatgcagcaccatgcccgtatcgtgttcgccgtcgcgatgcacgcgcacgcgattctcgacgtcgcgcacgcccatgcagccgtcggccagatcctcgatgtcgtgcttcatccagcgtgacggcaccgtgccgtccagcacgacgcagccgtcctgtacctgaacggtgacgtcgctcacgtcgatgtcgagcgcatgcgcgagccgctcgcacacgtcctcgcggatgcgctcgtccgaacgcgtatagcctttcggcccgcgacgatggcgcagtgcgtcgcgttcggcgtcgctgccatagcgcgaggtgtctcgcgggtcgccacggtcgtgctcgccgtcgttccggcccatccggaaatgaccgcggaattccggacggtcgccgccgtacgggccttcactgccctccgcacggcggcccggttcgcggtagccgcgttctgcctcccatgcgggctggcgcgcaccgccctgccggcccgggtcggacatgccgcgccgctggtccgccggccgcgcggcgcgctcggtccattcgctgccccagtcttccgcgccgacgctctcgctcgccgagcgacggcgcgccgattcagggtcttcgtccggccatcgtgccgggtcgtccgggatgccgcgctcgccgtgccgtccgggatatcgtcgttgcatcgtgtctctccttgttcgcgcctgcgccgcgcacggccccatgccgggtcgcgacacgacgcatgccggccggctcgaacgcaagccgcgtgccgatatcgctgccgtcgcacgacacatgcgcgccgcgccgtcgatccgctgccgggcgcgcgaatctgcaatgcgattgcagtttttgcgtgccgggcgtcatggcccgccgccggcgtccggatcgtccgggcccacggatgcgtcgtcgcgatccggcccgctcagccgctcggtgcgatccggctcgatatcggcgccttcttcgagcgtcgaatcgccgtccgccgacgcgcgctcgccggtgcccgcgcggtccgtatcgctgtcgagcgatgcatcgccgcgttcgagcgcatgcgcgtcgagcggcgaatcgatgtcgaacggataacgccgcgcgccggccgtgtcgctgccgctgtcggacgagtcgcccggccccagtgcgcggccgtcgcggccgcgacgggcgttgtcgtcgtccgggccggccggttcgttgtcggggttcagcgtgctgttcatgtcgacctccttgctggcgtgccgctgcttgccgctacgtgtggccgggcggccgcggcacggcatgcggacgggaggcgcgtgcaatcggcatgccgcatcgcgcgcccggaacggatgcccttgccgggatcgcggacggcacgggcgatgcgcgcccattgatcagccgaattgagttcccttatgctttccggggtgccaatccgtttgatgtggccaccgccggcgcgccggcggcggccgggcagcctttgcctgcccgtcttcgacctgccacacgatgaagaaagacgacgactctcctcgctcccatccgccgcccggtttacccgacgcgcgcgacctggtgcatcgcttcgccgagttccgttttcagacggtcgtcggctcgattaccgactacgcggtgttcatgctcgatccgcacggcaatgtcgcgacgtggaatgcgggtgccgagcgcatcaagggctatcgcgcggccgagatcgtcggccatcacttctcgtgcttctatccgcccgatgcgatcgcggccggccggccgtcgcacgggctcgaggaggcggccgcgcggggccacttcgtggatgaaggctggcgcgtgcgcaaggacggctcgcagttctgggcgagcgtgacgatcgcccccgtgcacgatcacgagaatcacctgtgcggcttcatcaagatcacgcgggacatgaccgagcgcaagcggctcgaggaactcgaagcgtccacgcaccggctcagcgtgttcatcgcgatgctcgcgcacgaactgcgcaaccatctctcgccgctgcgccattcggtcggcgtgctgcagagcctgcccgatccggcgcccgtgctcgcgcaatgccgcgacgccgtgcatcgccaggtcgggcaactgacgcggctcgtcgacgatctgctcgacgtcggccgcatcacggccggcaaggtcgagctgaacgatcgccccgtcgccgtgcgcgacatcgtgtgccgcggcgtcgaaagcatccagccgaagctggccgcgcgcgggcagcacatccacgtcgacctgccggccgatcccgtgctgctgcacggcgacgatgcacggctcgtccaggtgctgcacaacctgctcgacaacgcgtcgaagttctcgccgcacggcgggcggatcgacgtgggcgcacgggtggaagggccggtggtcgccatccgcgtcaccgatcatggcgtcggcatcgcgcacggcgcgctcgaaacgatcttcgacctgttcgagcagcgaggcgcgtcgggtggctcgccgaccggcggcttcgggctcgggctcgcgatctgccggacgttcgtcgaactgcacggcgggcggatttccgcggaaagcggcgggcccgggcacggcgcgacgttcacggtgcggctgccgatcacacggacgggacgtgcggagcaggccggcgtgcgcgagccggcggcgcacgcgccatcggacaccacgccgctgcgcatcgtgatcgtcgacgacaaccgcgactcggccgacacgctcgccgtgctgctcaaggtgaaggggcatgcgccgcgcgtcgcgtacaacgcaggcgatgcgctggcgctcgcccgcgactacgcgccgcaactgatgatcctcgacctgacgatgcccgacgtcgacggcttcacgctgctgcacgaactgcgcgcgatcgacgcgctgcgcgacacgacctgcgtcgcgctgtccggccacgcgcgcgcgtccgacctcgcacgcaccgaacgcgagggcttcgacgcgcacctcgtgaaacccgtcgagatcaacgtgctcgacgcactgctgcagcgtgtcgcacgcgggattcggcgtccgtcgtaacgcccgtgctcgaactgccgcacggctcgccgtggcgcggcattgcattcaatgcggcaacccgaacgcggccttcaggctcgcgacgatcatctgcatcgcgatcgccgcgaggatcatccccatcaggcgctgggtcaccgccgtcacgcgcggcgacaggtaatggccgatcagcggcgcggacagcaacgaaacggccagcagcacgagaaacgcggcgagcccgagcgcgaacgcgagttcctgtccggtcgagaacgcgctgtgcccgagcacgatcatcgtcgcgatcgtgccggggccgacgagcagcgggatcgtcagcggatagatcgcgacgctctcggccgccgccgggtcggcgccctcgtcctcgcccggcgaatgctggcggctcggcgcgccgtgcagcatcgacagcgcgatcagcagcaccagcagcccgcccgcgagacggaaatcgtcgatcgtcaggccgaatacgtgcaggatcgcgccgcccgcgacggccgacacgatgcagccgaccgtcacgccgatcgcggccgtaagcgcgaccttgcggcgcacgccgtccgccgcgccttcggtcagcgacaggaacaccgggatgttcgcgatcgggttcatgatcgcgaaaagcgccgcgaacaccttgatcgaaaaggtcaggtcgaaggccacaggttcgctcccgtctcacgcgtcgtttcgcatgccgaatcgcacgcaggttccgcttcgtttccggtgcacggcgcgcgccatgctgctacgatcgacgcaccgcgttcacgcacggagggccccgaccgatgcaagccaccgacaccttcatggatcacgagattcgcgtcgaggcgacgcgcaacgcgaacggcgcgtgggtcgcgcaggtgcggatcttccgcgacggcgcgccggtcgacctgcccgcgcccgaactcgtcacgcccgaatggctcacgtgcgacgaagcgctgcgcggcggcatcgaccagggccgcgtgatcatcaagacacgcgaccgctaacgtcgcgcggttcgtcgccgcatcgtcggcgggcagcgcgccgcgcgtttcacgcatcgaaatcgagatcgccgatcaggatttcgcggtcgcgctgggtccgtgagctgaagtcgaccggcaattccatctgccagcgttcgatcgtgaccggcagcgccgcgagatagcggtcgaagcggctgcggtcgggctcggccagcaatgcgtcgatcgcgtcgtcgcgccacgcgagccgcgcgttcaaccggttcggcagcccgaccgtcgacgtgaggccgatcacgtccacacaggtcggactcccttgcccgtcgtgcggcacgacttccacgcgcacgtcaccaggctgatacaggccgagcacgcgcgccgcgatgcgcggcgcaaactcggtttcgaaacgtgcgcggatttcagggctcatcttgcctccgggttcgaatcatgtcgtcacgcggccgtcatgcggctgcaatctgccgctcgaatgctgcttccgccttcaggctgtcgagatcgcggccgatcgtcgcgaccgcgagccgcgtgtcgccgcgccagtacgcgatcgcgcagtcgtgcgcgccgaggtcgccgtcgatctcgacgcgatcccattgctccgcatgcccgacgtagttgatcgtcaggtcgtaatgctggctccagaagaacggcaccgcgtcgaacgggcgctgctggccaagcatgttgtgcgccgcgacgatgccctgccgctcggcgacgacccagtgctcgacgcgaatgcgctcgcccgtcaacggatcgggccagcgcgcgatgtcgccggccgcgtagatgccgggcacactcgtctgaaggaagcggtcgaccgtcacgccgcgttcgacggccagccccgcttcctgcgcgagcgcgacgttcgggtgcacgccgatgccgaccaacacgacgtcggccggcagcacgtcgccggtcgacagcgtcacgctgtccggcgtgatccgcgccggcgtcgcgccgagatggaacacgacgccgtgcgattcgtgcagggccttgatcgtgtcgccgagcgcttcgccgagcacgcgtgccatcggatgcgcatcgggcgcgacgacctgcacgtcgagcccgcgcgtgcgcaacgcggcggccgcttcgagcccgatgaagctcgcgccgaccacgacgcagcggcgcgccgttttcagcttggcgatcagcgcgtcgcaatcggcgcgcgagcgcagcacgcacacgtgcggcagatccgcgcccggcacgctcagccggttcggctcggcgcccgttgccagcagcagcgcgccgtacccgacacggctgccgtcggccagttcgaccgcctgccgcgcggggtcgatccgcgcgacacgcgtgccgcaccgcacgtcgatccggtggtcggtatagaacaacggcgcacgcagcggcagccagtcggcatcggccgtgccggcgagatagtctttcgacaggttcggccggtcgtacggcggatcggcatcggcggtaagcatcgtgacgggatgcggataacccgcctgccgcagcgtcacggcggccgcgatcgcagcggcgccgccgccgacgatcaccaccgacgcaggcagcccggccgcattcagcgcgggaggcgcggcggccggccgcgcatcgagcacgacggcacggccgtcgcggcgttcgacgcgccagcacgggagcccgtcgagcgccggtgcgcgcagcagcgcgcccgtgcgcaggcagaacgccgcgtgatgccatgggcagtggatcgtgtcgccctccagcaggccgtcggccaatggcgcgccgtaatgcgggcactgcgcgcccacggcaaacagttcgtcggcgcggcgcacgagcagcaccgcggtatcgccgacatggccctcgatcatcgcgccgtcggcgagatcgtcgagcgcgatgccctgcgtgaggtcggggcgtgacgacgaagcgtcgcttccagtcatgacatggctcccggaaagtcaggtaacgatcccattatcgacatcccatttgaaaagaacaggtacagacgcctccgcagcgcacgcaaacaccgactgtagcttgtacgcgagccatgacgggcgtagaacgtcatcaacgttgcggcgcaacacacccgttgcctgcgagggcacgtcgcgcgtcctgcgcaatccgcgtgccacattcccccttcaccaggagtgctacccgatggccaccgtcctgtgcgtgctctaccccgatccggtcgacggctatccgccgcgctacgtgcgcgatgcgattccggtcatcacgcactacgcggacgggcaaaccgcgccgacgccggccggcccgcccgggttccggcccggcgaactcgtcggctcggtgtccggcgcgctcgggttgcgcggctatctggaggcgcacggccacacgctgatcgtcacgagcgacaaggacggtcccgattccgaattcgagcgccggctgcccgaagcggacgtggtgatctcgcagccgttctggcccgcgtacctgacggccgaacggatcgcccgcgcgccgaagctgaagctcgcgctgacggcaggcatcggctccgatcacgtcgatctcgacgccgccgcgcgcgcgcatgtcaccgtcgccgaagtcaccggctctaacagcatcagcgtggccgagcacgtggtgatgacgacgctcgcgctggtgcgcaactacttgccgtcgcatgcgatcgcgcagcaaggcggctggaacatcgccgattgcgtgtcgcgcagctacgacgtcgagggcatgcatttcggcacggtcggcgcggggcgcatcgggctcgccgtgctgcgccggctgaagccgttcggcctgcagctgcactacacgcagcgccaccggctcgacgcgtcggtcgagcaggaactcgcactcacgtatcacgccgatgccgcgtcgctcgcgagcgccgtcgacatcgtcaacctgcagatcccgctttacccgtcgacggagcacctgttcgacgcggcgatgatcgcgcgcatgaagcgcggcgcgtacctgatcaacaccgcccgcgcgaagctggtcgaccgcgacgcggtcgtgaatgcggtcacgtccgggcatctcgcgggctacggcggcgacgtgtggtttcccagccggcgccggccgatcacccgtggcgcgcgatgccgttcaacgggatgaccccgcacatctccggcacgtcgctgtccgcgcaggcacgctatgcggccggcacgctggagatcctgcagtgctggttcgacggcaagccgatccgcaacgaatacctgatcgtcgacggcggcacgctcgcaggaacgggcgcgcagtcgtaccggctgacgtgacgccacgcgccgcgcccgacgcgcggcggtacggtcagtcgacgcagtaggcggcgagcttgccgacggtcacgaccgcctgctcgatctccggcgaccacgggctgctgtagttgaggcggatgaaattccggtagctgtccgcgatcgagaacatgtagccgggcccgatcgtgatgccctgctccagcgcgagctggtacagccgcatcgcgtcgacctgcacgggcaactcgacccacagcacgtaaccacccgccggactcgagatgcgcgtgccttccgggaagaaccgcgacaccatcgtgcgcatcaggttcgcctgctgcgcatacgccttgcgaatccgccgcaggtgatgctcgtagccgtcgcgttcgagaaactccgcgatcgcgagctgcggcagcgacggcgtcgcgagcgtgttcaggaatttcagcttctcgacctgctcgcgataacggcccggcaatgcccagccgatccggtacgcggccgtcaggctcttcgagaacgacgagcaatgcagcacgatgtcgtggcggtcgaacgacttcagcgtgctcggatgcatgttgccgaagtacagttcgttgtacacgccattctcgatgaccggcagatcggccttcgcggcgaactcgaccagttcgcgcttgcgctcgtcgggcatctggaagccgagcgggttctggaaattcggcatcaccatgcacgcggcgatcggctgcgacttcgcgatcgcggccagcgcggcgatgtcgatcccgtattccggatgcgtcgccacctcgatcgccttcatccccatccgctcgatcgcgtgcagcatcgcatagaacgtcggcgattccaccgcgatcgtgtcgcccggtttcgccaccgcctgcaggcacaggttgatcgcctccgtcgcaccgaccgtcacgatgatctcgttcgggtccaccgacatcccgttttccaggtagcgccgtgcgatctgacggatcagccgcggatgcccgggcggcaatccgtccgtcacgccccacaacgacttgtcgcggccggccgcgtacgcatagcggttcagcttctcgaacgggaacaggctcgggtccgggtacggcgagccgagcggcactgcgtcgtcggtgccgatcgagcgcagcgtcgacaacacgagccggctcacgtcgaccgacgacgagatcgcgatcggcttcgacggccgcagctcgcgcaccggcgcatggccgtcgtcgcgccgcaggttcacgaaatagccggactgcgggcggctttcgagcagcccgcggctttccagcagcagatacgcgtgcagcacggtcgtgatgctgatccggtgctgctggctcgcctgccgcaccgacggcacacgatcgccgtgtcgatatacgccttgccggatgagtctctacgtcgtttgcaaacttctcgtagagcttcatccgcctcgccccgccagcgatgaaccggcctgcgctgcacgggcggcatggccgcgccggtgcacgaagccggatagccgtgcccgggcgcggggtcccggttcgaacctcgtccgttatcgaaattgaaggcggatagcaacgcgaatctcatctagacaaggttcggcatcctactgcgtcatttcgacgaatgtaagtgacagtttggcgaggaaacgccaaatccggccggcgtggtgaacagattcgaacgcgacggcacggcccggcgcggggccattcaccgggctccatgcaggagcacgtgctcgcgtattgccgacggccggcgggcggccatcacgcgaagcccggtcatgcgcgggcctcgcgtgtgatcaagcgtcgtcgacgttgtccgcgtagtggtcgatcgcgaccttgcactcgtcgaacaccaccgtcagccacgcgacgtcgttcgactcgacccacttgcggatctgcaggaattgcccggtgccgagatcggcgacgcgggccggatcgtcggtcgtgacgtcgacggtcgcgatcgcgcgcttgccgctgccgggcagcggcgtcaacgtcgccgcgatgtcgaagcgccggtatgattgatcgatgcgcatgcggttctcccgaagcaggccgaaaggaagcgtctcactcgagcgtctggcggaacaccttgccgccgaatcccgtcacgacgttgtcgaccgagaacggcgtgtcctccttcgcttcgaggatgaccgcgacgctgccgggcacgagccgcgccgcaatcgtctcgacgaacgtgccgtcgagcagcgcgttgccggccgcttccgcgagaatgccggcccccgcgccggccgccatgccggtgaccacgccgagcggcccggcgagcagaccgagcaacccgcctgcgatcgcgccgatcacgccacccttgaacggacgcgattcggcatcgagcaccgcgagcttgccggtcgcgtccttctcgacgacgacaccgttctcgatgtggaatccctcatgcttgtccgacagcgcctcgaaatcgctcgcggcccgacgggccgtgtcgacgctgccgaacacggcgacgatcagttgcctggtcattcgatacctcgctcggttggttggttggttggtcagtttgatcagtttggcggctttggccgctttggccggttacagccgccgcactgcatgcggcacgccgcccgctcctcacctgcgcgcatgcacatcgtcctcgacatcgtcgacgtccgccggaaagcgatgctggccgaaactcaggatcagcacgcccaccgcgagcagcacgattccgaacgtcgtcatcagcatccgctcggggctgtcggtcgccccgcgcaggatcaggtcgcgcgcgagcgacgtcatcgcaatgaacagcggaaaccgcacgggcagccggccgagccgcaggtagcgcacgtccatcgcgagcacttccaggtacaggaacatcagcagcaggtcggtcagcgacacctcgcccgccagcacgaccttccacgcttcctgcgccatcgcgaacgcggtcgcgagcccgatcacgatcagcccggccagctcggccgcgtgaaggaaatggccgaagcggcggcgaatgcgctcggccggcgagctgggaacggtggtcgtattcaaggtgacagtcgcgttgaggaaacttgaacggcgccgggtggcgggaacgccgcgtcgcgcgcggcagcatgcacggccccgctatcgggcgcgtcaggcgcatcgggcgcatcctgcaccgccggcgcgtgcgggccggccgcgccgatcgcctgctcgaccgcggacagcgtccggcggcagcacacgtggaacgcgacgcccgcatcggagcaggccacgtcgtcgtgctcgcggcacagcagcaggcgacagccgagataccgttcgaggcagtcgatccgttcgctcacctgcgcttcgtcgagccgcagttcggacgccgcgccggacaggccgccacgctcgaccaccgcgacatacacacgcatcgcttccagcaggttcatgatgacgctcctcgtcggcgggcgcagcggaacctaatctactgcacgcgccgcgcacgctcaagagcacagcgccgcgcacgccaggagtacagctgcgcgcgcgccgaaaaccggccctgtttgacgcattcgcatgacagttcggcgatacgggttccaaagccccgccgaagctgctagattgcttgctcgacgacgttacgcggtgcgggccggtcacgcgccgcgcggccggccgccaccgccgcggcccgttgcgcgaggcacgcgcgacgtccttcatccgcatgacaccaagagaacagtcgcatgacacagttcaaccgttcgccttcgcgcgccacggcccgcccgtcccgacatgactgaccggcagcccacgatgcagacacctccccactctcccaggccgttcacagcccgatcacgcgcagcgcgatcttcctcgtggcgacgatcaatcccggcgccgatcacgccgacacgatccgttcgtggtgcggcgacatcgccgcgctcgtgcgctcggtcggcaagcgcgtgccgggcggcaacctcacctgcgtatgcggcttcggcgccgacgcatgggacgcgctgttcggcgacccgcgtcccgccgcgctgcatccgttccgcgagttcggcgcggggcagcgcgtcgcggtcgcgacgccgggcgacatcctgctgcacatccgcgcggaagcgatggacctgtgcttcgaactcgcgacgcagctgctcggcgcgctcggcgatgccgtcacggtggtcgacgaggtgcatggcttccgcaatttcgaccagcgcgcgatgatcggcttcgtcgacggcaccgaaaacccggaaggccgcgaggcggtcgacttcacggtgatcggcgacgaagacgcggaattcgcgggcggcagctacgtgatcgtgcagaagtacctgcacgacatggccggctggaacgcgctcgcggtcgagacgcaggagcgcatcatcggccgcaccaaattgtcggacatcgaactcgcgccggacgtgaagccgtcgtgctcgcacagctcgctgaccacgctcgacgagaacggccaggaagtgaagatcctgcgcgacaacatgccgttcgggcgcccgggcgcgggcgaattcggcacctatttcatcggctacgcacgctcgccggcgccgatcgagcagatgctcgagaacatgttcgtcggccggccgcccggcaactacgaccgcctgctcgactacagccgcgcggtcaccggctcgctgttcttcgtgccgtccgccgacctgctcgaagcgctcgccgatcgcgcggcgccggccgccgacgccgcgcagccggaagcgtcgccgtccgcaccgcatcgcgacggttcgctgaaaatcggctcgctgaaaggcatcccgtcgtaacgccgggtaccgatggccgtccggcgcgcgaccgcgcgccgggcgtgtcgggaaccgcctctgttcagtcggccggagcgcgcgtgcagcgctgcgcaacacccctccaccgcgccaccgcttatgggcagtgacgcgcgcaggcttgcattcccggcacgccgcccacgcgactcaacccaccagaatatagagccagttcttcggcaacgccccgcccgggccgttgctgcatgccagcagccgttcgccggattgggggtgcgtgatgccggtacggaacgtctcgatggccttgcgctccagacggtcgaacgcgttcccgaccaggttgtgcgcttcgagatagatcggggccatcagcttgaagtcaggcttggtggcgcgatgtttcgccagccgggtgtacaggtcgctggtgatgccgatatagaacttgctgtactccggcttcgcggcaaacgcgttcaacacctgccgcaaatgcccgatgacatcctcgtgattgatgacgcccgtcttcagcatgtatttgtcttcgggcgagacgagttgcaatgccatgaacgacctccacttgttgtgaagcatcaataggctgcgtctatgattcatccgggcccggctccgacgaccgcccaacccctgctgctggcagaaacccggctggatgaatgttcgtaagaatgcacgactcgcgacgggacgtcgaccggaattgattccgcacagcgtcgaacgcggcccgggcgacggtgccgccggcacgccccgggtatcgcggcaatccagtcgccgcattccgcgttcgcccacacccgcaccgcacgaattgcatcacagttgcgcgaccgcacggtgtcgtttcgatttgtgctgcagcggtgtcgatcgagcctgctaatattcattttcgtccgcgatcggcaggctggcatcacgcacagcccgtcagccgatcggcccgccatcaagtgtttccgctgacgtgaggcaatccaaatccatgaataacctgcaccgcgaactcgccccgatctcgtcttccgcctgggaacaaatcgaggaggaagtggcacgcacgttcaaacgatcggtggccggccgccgcgtcgtcgatgtcgacggccccgaaggccccgagctgtcggccgtcggcaccgggcacctggtcgccgtcgacgcgccccgcgagcacgtgaacgcgcggctgcgcgaagtccgcacgatcgtcgagctgacggtgccgttcgagttgagccgcgatgcgatcgacagcgtcgagcgcggcgcgcgcgatgccgactggcaaccggcgaaggacgccgcgcagcggctcgcgttcgccgaagacaacgcgatcttcgacggctaccgggccgccggcatcgtcggcatccgcgaaggcacgtcgaaccgcaagctcacgctgccggcggacgtcagcgcgtatcccgacgcgatcagcgacgcgctcgaggcgctccgcctggccggcgtcgacggcccgtattcggtggtgctcggctcggatgcgtacacggcgctcagcgaggcgcgcgaccagggttatccggtcctcggccatatcaaacggatcgtcagcggcgagatcatctgggcgccggcgatcagcggcggctgcgtgctgtccacgcgcggcggcgattacgagctgcatctcgggaagacgtatcgatcggctacacgagccataccgacaaggtcgtccgcctgtacctgcgcgaaacgttcacgttcctgatgctgacgagcgaagcatcggtggccgtcgcaccgcagggcaacccaacggcctgacctcggctgtccgcgcgatgcccgccgggcgtcgcgcgcggccggccgcaccgccggccgcatgttcgtcgccgatcgaacccactttgcatggagtgtgtgatgagcgagtcgaatgaggcattacaggcgctgcaggcgtcggtcgaccagctgaagaaggcggtcgacgcgaacgcgagccgccaggccagcgataccgccgtgctgttcaccgtcctgtcgctggtcctggccgagttgccgcccgacacgcgcaacctgatcgaggattcgttctccgtctgggccaatggcctgccggatacggcactgtcaacggacgttaagcagatcgcccggcaacggctcgcgatgaccctcccggactgaccgcggcacgccgcggttgcgccctgtccggtccggaccgtgcaacccgcctgctccttcggccgccacgcacgcatcgtccgcggtgcgcgcacggttgcatccggccgctcgccgcacgtccccgtgcggcgcttccgtcgcgcccgaccacccgcggcgccctccatccacctgccaccggcgccctgcgcgcccatgtcgcaccgcccccgttcgcgtggcgcccgctccgctttccggtcaccgtacgttacgcgtaccgcgcacgcccgcgccgccgtgcatccgcccgtctgtgctcctcttcgcccgtgcgcgcccgcatccgagggtgcaattcgcagccgggccggcgcggaactgtgtcttggatggcctccgccgattcgctattttgaacgcagtcgaagcgatgccgtgggctcctcccggcacgcacgcctgccgtcctgaccgcgaccgcgcacgacgccggcgcgcactgcgcgacagcccgggcacggcccgcgcgccgccgtgccgccctgcttcatgtcgtgcgttcgcggtcgggccgcgcaagcgccgcaccgcatcgggacttcacccttcgacccactttcaccgacaggagccagaccaccatgcccgcactttgcgatatctgccacgcccggccggccgtcgcgcgcgcaaccgtgatgcaggacggcgagcgcaagaccatctcgatctgcgactaccacttccgtcagctgatgcggcatcaaagcatgctgaacccgttcgattcgctgctgggcggcggctcgtcgtcgctgttcggcgggctcggtgacgaatcgccgctcgccgccgaagtcccgcgcgaatcggtcgacccgaccgacgcgttcagcgagcagacgctggaactgctgcagcgcgcggccgagaaggcgcacgagctgcgccgcagcgaactcgattccgaacacctgctttacgcgctcgcggacaccgatgtgtgtgccgcgctgctgaaagaactgaagctgtcgccgcaggacatccggtcgtacatcgacgagcacgcgcacaccggcacggccgaccccgatgcgccgctcgacaagctgtcgatctcgccgcgcgtgaagaaggccgtgcagtacgcgttccaggcgtcgcgcgatctcggccactcatacatcggccccgagcacctgctgatcgggctcgcgtcggtgccggacagcgtcgccggcacgctgctgaagaaatacggcgtgacgcccgaggcgttgcgccagaaagtcgtgaaggtggtcggcaagggtgccgaggacggccgcgtcgatgcgccgaccggcacgccgaacctcgacaagttcggccgcgacctcaccgcgatcgcgcgccagggcaagctcgacccggtgctcggccgcgcgcaggaaatcgagagcacgatcgaggtgctcgcgcgccgcaagaagaacaacccggtgctgatcggcgagccgggtgtcggcaagacggcgatcgtcgaagggctcgcgcagcggatcgtcaacggcgacgtgcccgaggtgctgcgcgacaagcggctcgtcgaagtcaacatcaactcgatggtggcaggcgccaagtatcgcggcgagttcgaggagcgcgcgaagcagctgatcgacgaagtcacggcgaagcaggacgaactgatcctgttcatcgacgagctgcatacgatcgtcggcgcgggccagggcggcggcgaaggcggcctcgacatcgcgaacgtgctgaagcccgcgctcgcgcgcggcgagctgagcctgatcggcgcgacgacgctcaacgaataccagaagtacatcgagaaggacgccgcgctcgagcggcgcttccagccggtgttcgtgccggagccgagcgtcgagcagacgatcgtgatcctgcgcgggctgcgcgacagcctcgaggcgcatcaccaggtgacgttcgccgacgacgcgttcgtcgcggccgcggaattcgccgaccgctacatcacgtcgcgcttcctccccgacaaggcgatcgacctgatcgaccaggccgccgcacgcgtgcggatcggcgcgacgtcgcgcccggtcgacattcaggaaggcgaagcgcagatcgcgcaactgaagcgcgagcaggactacgcgacctcgcgcaagcgcttcgacgaagcgaagcagttcgaggagcagatcaacgcgaagcagaaggccgtcgacgagaagatggaggcgtggcagcgcaagacgggctccgagacgctcgaggtgacggtcgaatccgtggccgaggtcgtgtcgcgcctgaccggcatccccgtgtccgaactcacgcaggaagaacgccagaagctgctgaagatggaagagcagctgcgcgagcgcgtggtcggccagagcgacgcggtggtggccgtcagcgatgccgtgcggctgtcgcgcgcggggctcggccagacgcaccggccgatcgcgacgttcctgttcctcgggccgacgggcgtcggcaagaccgagctcgcgaaggcgctcgccgagaccgtgttcggcgacgagcaggcgatcatccgcatcgacatgtccgagtacatggagcggcacgcggtcgcgcggctgatcggcgcgccgcccggctacgtcggctacgacgaaggcggccagctcaccgagcgcgtgcggcgccgcccgtacagcgtgatcctgctcgacgagatcgagaaggcgcacccggatgtgtacaacgtgctgctgcaggtgttcgacgacggccgcctgaccgacggcaagggccgcgtggtcgacttcagcaacacgatcatcatcgcgacgagcaatctcggcgccgcgatcatcatggacaacctcacgcagccggaagccgcgcgcaagaccgacaaggcaatccgcgaggaactgatgcaggtgctgaagggccatttccgccccgagttcctgaaccgcatcgacgaggtgatcgtcttccacgcgctgtcgaaggagaacatccgctcgatcgtgcagatccagctcgaccgcgtgatccgcacggccgccgcgcaggacatcacgctcgtgatgggcgattcgctcgtcgagcacctgacagaagccggctaccagccggagttcggcgcgcgcgaactgaagcgccagatccgccagaccatcgagacgcggctcgccaaggagatcctcgccgaccggctgaagtcgggcgacaagtgcgaggtcgactacgacaaggacagcgacgaagtgaagttcaacaagctcgccgcgcctgaagcgaaggaagcgaaggacgccgacggcaaggccaagcccaacggccgggccgccaaggcggcagcagacgcgaaaccggacgacacgcccgccgacgccccgccgcccgcggcgaaacccggcaagaagtcgtccggcgcgaagaaggacgcacactaaaacaacgcatgccctgcaacccggggcacgcatgaccggctccgtccgccggacggagccgccccacgccgacacggcgcaaccgagccacccgcaccgggcccggctattggagattcaccatgacaaatcgacgcgaagtgccaggcatcaggaagtacgacgggcccgccggcggttggggcgcgcttcgcgcgacagccgacgcggtgcgcacccagatggagaccatcgaggcgccgatcgtgctgatgcggaccaaccagcccgacggcttcgactgccccggctgtgcgtggcccgacaaggaacacaagtcgacgttccagttctgcgagaacggcgcgaaggccgtcacgtgggaagcgacgaccaagcgcgtgacgcccgagttcttcgcggcgaacaccgtgtcgtcgctgctgcgcatgtcggactacgaactggagaacatgggccggctcacgcatccgctggtctacgatcgcgcgaccgacacgttccgcgagatcgcatgggacgatgcgttcgcccgcatcggcgaagtgctgcgcgcgctgccgccggagcaggtcgagttctacacgtcgggccgcgcatcgaacgaagccgcgtacctgtaccagctgttcgcgcgcgagctcggcaccaacaacttccccgactgctcgaacatgtgccacgagccgaccagcgtcggcctgccgcagtcgatcggcatcggcaagggcaccgtgtcgctggaggatttcgaccactgcgagctgatcatctcgatcggccacaaccccggcacgaatcacccgcggatgatgggcacgctgcacgagtgctcgcggcgcaacgtgccgatcatcgtgttcaacccgctgcgcgagcgcgcgctcgaacgcttcgcggacccgcaggacatgatcgagatggcgtcgttcggctcgacgcggatcgcgtcgacgtactaccaggtcgacgccggcggcgacgcggccgcgctgaagggcatcatgaaggcgctgctgaagctcgaagccgagcaaggcaacgtgctcgaccgcgatttcatcgcgcagcacaccgacggcttcgacgcgttctcggccgacctcgaggccacgtcgtgggacgacatcgaacgcgcgagcggcctcagccaggcgcagctcgaacaggtcgcgctcgcgtacgcgaagtcgaacgcgacgatcgtcacgtacgggatgggcgtcacgcagcacaacaagggcaccgcaaccgtgcgcctgatcgccgacctgctgctgatgcgcggcaacatcggcaagcccggcgccggcgtgtgcccgctgcgcggccattcgaacgtgcagggcaaccgcacggtcggcatcaccgagaagccgtcggccgagttcctgaagaagatcgaggacgtgtgcggcttcacgccgcccgcgcatcacgggcacgacgcggtgcaggcgatgcaggcgatgatcgacggcaccgcgaaggcgctgctgtgcctcggcggcaacttcgcggtcgcgctgcccgatccggaacagtcgttcccggcgatggcgaagctcgacctgagcgtgcatctcggcacgaagctgaaccgctcgcacctgctggtcgcgaaggaaaccttcatcctgccggtgctcggccgcaccgaactcgacatgcaggccaccggccgccagtcgatcaccgtcgaggattcgatgtcgatggtccacgcgtcggccggcaagctcaagccggcgtccgaccagctgcgctcggagcccgcgatcgtcgcggggatcgcgcatgcgacgctgccgaacagcaaggtcgcatggctcgacctgatcgccgactacgaccgcatccgcgacctgatcgaccgcacggtggacggcttcgaggcgttcaacgagcgcatccgcacgccaggcggcttccggctgccgctgccgcccaccgagcgcgtgtggccgacgccgaccggcaaggcgatgttctcggtctacaagggcgtgaaggaggatgccgacgtgctcggcggcgagcaggtgctgcggctcatcacgctgcgcagccacgaccagtacaacacgacgatctacgggctcgacgatcgttatcgcggcgtgttcgggcgtcgcgacgtgctgttcatgaacccggccgacctcgcgaagtacgggctcgaacacggcgacctggtcgacatcgagacgatcaccgcatcgggccgcacgctgcgtctcgagaagatcaccgcgatcgagtacgacatcgcgccgggctcggtcggcgcgtactacccggaagcgaacgtgctcgtgccgctcgactacatcgacaaggaaagcggcacgccgtcgtacaagtcggtgccggtgcacgtcgtgcgctcggcggtggtctgattcgcgggcaggcgggttcgcgtcgcggcacgccgcgcgcctgaacccgcctgccgccccgctcccgcctttcccggccgccgcatcgcaaccgatgcggcggccgtttcatttcatcgcgccgaacgacgcccggcttaccgcaccgccgtcggcggcatcgtcgcgcccgtctgccggcgccgatacgcgctgtcgcgcgtcgcgagccagtagtacagcggcgacgtcagcgcgagccccacgagccacgacaggtccgcgccgccgagatgcgcgggaatcgggcccgcatacatcggcgtgttcatgaacgggatctgcacgaggatgccgatcgcgtacgcgagcagcgcctgcgggttgaagcggccgtagatcccgccgtcggccatgaagatcgactggatgtcgtacttgcccttgtggatcacgtagaagtcgatcaggttgatcgcggtccacggcaccagcacgacgagcagcgcgagcacgagatcgacgaggttgccgacgaagttcgtcgacgcgccgatcgccgcgtagcagcacgcgacgaagatcacgaccgacaccaccgcgcgcgccttcgcggtcggaatccacaggtacgcgaacgtctgcaccgacgtgatgaccgcgagcaccgcgccgtacaggttcagcgcgttgtggctgatcacgctcagcaggaacagcacgagcatcagcgggccgagcgagccggtcgcctgcttgaccgcatccatcgtgtccgcgccggccggcaccgcgagcaccgcgaccgcgccgaagatgaacgcgagcgtcgagccgatcgtgcagccgaggtaggtcgcccagaacgtcgacgccacgccgacgttttccggcagatagcgagaatagtccgacacgtacggtgcgaacgcgatctgccacaacgccgacagcgacaccgtcgcgagccagcccgcgaagtcgaagccgccgcgcgtcaggaaatcgtcggtcgtcacgtgcgagaggatcatccagaagccgacgacgatgccgatgccgagcacccacgtgccgatccggttcaggatgtggatgaaccggtatccgacgatcccgatcagccccgaacccaccgcgccgatcacgatgccgacgggcaccggcaccgacgccgcgatgccgtgcaccgacttgccggcgagcacgatgttcgacgcgaagaaaccgacgtacatcacggccgcgatcacggtgacgagcaacgcgccccacgagccgaactgcgcgcggctctggatcatctgcgggatgcccatctgcggcccctgcgccgaatgcagcgccatcagcacgccgcccaccgcctggccgacgacgatcgcgacgatgccccataacaggttcaggtggaacatctgcacgccgagcgcgccggtcacgatcggcagcggcgcgatgttgccgccgaaccagagcgtgaacaggtcgcgcaccttgccgtggcgctcggcgggcggcacgtagccgatcgtgtgcttctctatcatcggggacgcattgcgttccgcattcgtcatggtgaagtctcctgtcctgcgcggcgatgcgcgcgtgccgtggcagccggcgcgcgtcggggtgcgcgccggcaatcgggtccggatacgcgaacgacgacgcaccgcgtgcacgcgcggcggagtcgaacgcagcgaacgaaccgctcgcggggacggatgccatgccccgccggcgcgtgtgcggccgcttcatgatcgtggtgatcttcgcgatccaggttggagacgatggtgcgccacgggtatcgcgaccggaaaatactaaaaatatttccgggacatacgaaaaagctctgcagcggaaattccggcgcctgggcctttcaggtaggtgctacgcacaaccatggacagattgcgcccgcggcgcacgccggggccgtgcatcagaggtgcatgtggctcactacactttgcggcaactgaaatacttcgtgacgacggtggaatccggcagcgtggccgaggcctcgcgccagctcttcatcgcgcagccgtcgatctccagcgcgatcaaggggctggaagagagcttcggcgtgaagctgttcattcgtcatcatgcgcagggcgtatcgctgacgccgggcggcacgcgcttctaccggaaagcgcaggagctgctgcgcatcgcgcacgaattcgaacagaacgcgctcgccgacaacgacgtgatcaccgggcagatcgacatcggctgcttcgagacggtcgcgccgctctacctgccgcaactgatcgcgggctttcgcgagcgctacccgggcgtgaacatccggctgcgcgacggcgaccagcaggaactcgtgcagggcctgacgtccggcacgttcgatctcgcgctcatgtacgaccacgatctcgacggcacgatcgagaccgaaccgctgatgccgccgcagcagccgtacgtgctgctgccggagaaccaccggttcgcgggccagacgcacgtgtcgttacgcgacctctgcgtcgagccgatgatcctgctcgacgtgcagccgagccgcacctatttcgtcagcctctttcacgaactcgggctgacgccgaacatcgtgttcgggtcgccgtcgatcgagatggtgcgcgggatggtcggccagggttcggcttctcgctgctcgtcacgcgcccgcattccgaatacacgtacgacggccagcgggtcgtgacgatcggcctcagcgaaacggtgagcccgtcggggctcgtgagcgcgcggctgaagcgcggccagctcacgaagcaggcgcagtcgttcgtcgacttctgccgcgagcggctcgcgcagatcgtcgcggaaacggcgagataagacgcgcaaacacgcacgcgccgcgcgaggcggtgcgtgcatttttgcagtgacgatttcaggcggccgacgacagatacgcagccagacgactcagcatcgcgtcgcatccatgcagctggtcgagcgtgacgaactcgtcgggcttgtgcccctggtccatgctgccgggcccgcatacgacggccggaatcccggcctgcccgaacagcccgccctcggtgccgaatgcgaccgtgccgaacgcatcggaaccgctcagcatcgcgagcaggcgcgcggcctcgctgtccggcgccgtggccagccccggatacgcgcccagcggctgcaatcgaatgtcggtgtcgggctgcaccgcacgcattcgcggcaacagttcggattccgcatagtcctgcagcttccgcggcacgtcgtgcgcgtcgaaatccggcagcgcacgcacctcgaagtcgaactcgcattcggccggcacgatgttcagcgcgcggccgcccttgatcagccccgtctgcacggtcgagaacggcggatcgaaacggccgtcgtgccgttcgggccgcgcgagcgccgcgccgatctcgccgagccggccgatcagcttcgccgcatagtcgatcgcgttgacgcccgacggcgcgtacgccgaatggcacgcggcccccttcacgtggcagcgcatcgcgagcttgcccttgtggccgagcaccggcctcagctcggtcggctcgccgatcaggcacaggcgcggccggtgcgcacgcgcggccagtgcgtcgagcatcggccgcacgccgaggcagccgacttcctcgtcgtacgagaacgcgagatgcacgggcacgcgcagcggccgtgcgacgagcgccggcacggccgcgagcgccgacgcgatgaagcccttcatgtcggccgtgcctcgcccgtacaggcggccgtcgcgctcggtcagccggaacggctcgaccgtccacgcctgtccgtcgaccggcaccacgtcggtatggcccgacagcgcgatgccgccgcgatcgcgcggcccgatcgtcgcgtacaggctcgccttcgtccgttccgcgttgtagaacagttcgctctcgacgccgaagcccgcgagatagtcgccgatgaaaccgatcatctcgagattcgaatcgcggctgaccgtcgcgaaaccgatcagccgctcgagcaacgcgcagctcgacgtgtcattcatcgcccggcactccgtagctcggcgcggcggtcgggttcagcgcgcgcgtctggtagtcctgcatctgcggccgatacgcccgccacagcgcatcgagctgcccgaccggatcggcatcggcccagtcgacgcgcaggtcgacgatcggccaggtcacgtcgccggccaccttcagcgcggccgagtgcaccggccccgcctcgccgccggccgcgatcgccgcctgcatcgcggcgagcaggcgatcggcgagcaggccgggcgcctgctcgaaggcgcgcgccatcgcgtcgatcacgtccggcgaagccagcaggttgccggccgccacgcactgttcgccgcgcaccgcgtgatgcgtgccgagcgcttccttgccggtgaagcatgcggtctgcccctgcccgtcgaccaccgtgacctgccggtactggctccagccgttcgcgctgagcgcgcggtcgagcgccgcggcaggcgcaagctgttcgtgctcgatcaggtcgaggatctgcgggccgagcgccggcagcgtgatgttctgtgtcgcgacggcgccgacgcccgcgcgcacccacgggcagcgcgcgcccaccgcgatgctcgacgagctgatcgcgatgccgagctggcccgtctccgggcagcgcccgacgatggagaaagtcatgtggcctcccgggcgccgttcggctgccagttgtccggaatcacggcgatcacgtcgatttccatcagccactgcggctggccgagcgcggacacgacgagccccgtcgagatcggatacacgcccttcagccacttgccgacttcctggtacaccggctcgcgataacgcgggtcgatcaggtaggtcgtcgtcttcacgatgtgcgtgaggtcgctgccggcttcctccagcagctgcctgacgttcttcatcgcctgctcggcctgcgcgcgcgggtcgccgaggccgaccaggttgccgtcgaagtcggtgccgacctggccgcgcacgtagacggtgttgccggcccgcacggcctggcacaggtcgttgtcgagcgtctggttcgggtaggtatccttcgtgttgaacatgcggatacgggtatgggtcggttggctcatcgaaatccttcagtcgtcagggcacgccgccgcaccgggcgcgaacacgatcgcggtgcggcaggcgggcggcatggggtcggtcagttgaccgcgtcggcgagcggccgcgcgtcggcgtgcgacgcggcgccgcccggctccgggcgcgatgccgggcggcgctgcgaggcgtcgtggtattcgaggtaggtgcgctgcgtcgcgatgtgatcggcgatgtgccgcgcgtcgtgccacacgccccagatgaagctggagccgcgccgcgacagccacggcagcccgaggaaatagatgcccggctcattcgacacgccgcgctggtgccgcggcttgccgttcgcgtcaaacgcatcgaccttcagccagccgtagtcgaccgcatatcccgtcgcccagacgatcgacgtgacgcccgcgccggcgagatcgagcgcgaggatcgggtgcgcgacgcagtcggggttcggcaggatgtggcgggcgtcgggttcggccggcaggtcgaggccgttgcgggccgcataggcgtcggccgcgtcgagcagcgacaggtagttctcgtcgccgcgcgcgagattgatcgcgagatcgcgctcgaacgtggccacgccgccgctgaacgacttcgtcagcccgacgagcgtcacgccctggttcgcgagcttgcggaaatcgaccgtatggccgccgcgcgcgccgctcaccgcgatcgtcacgtgttcgcggccgggcgtcgcgacttccttgtcccattcgccgagcacgccgagccaccagcagaagtcacggccgcgatacgcgcgcggcgggcggtcgtgcgggcccaccgacaggtagacccggcggcccgcgcgctgcagctcgtcggcgatctgcacacccgacgaacccgcgccgaccacgagcaccgcgccgtccgggagctggcccgggttgcggtagtcggcggaatggagctgcacgaggcgcgcgtcgtccggcgcgatgggcggaatcaccggacgctggaacggccccgtcgcgacgaccacgcggttcgcctcgatcgtgccgtcggacgtctcgacgacgaaacccggcttgccggtattgcgcacgacccgcttcacctcgacgccggtgcggatcggcgcgtcgaacttgcgcgcataggcttcgaagtagtccgcgacctggtctttcgacgcgaacgcgtcggggtcgaggccgtcgaattcgagccccgggaagcggtcgtgccacgcggggccgttcgcgaccagcgaatcccagcgccccgtgcgccagcgttcggcgatgcggctgcgctccagcacgagatgcggcacgcccagcttgcccaggtgctcgctcatggccacgccggcctgaccggcgccgacgacgagcgtatcgattgaggttgtttcgactgccacggctgtctccttctgaagtgcggctcgacgcgacgcgcgtgctgtcgctcgagctggaatggagacattctgctgacacgccgcttgcggcgaaatgatgatttttgttggtgttgatgagcaaaaagctgggggcgcgcgggcgtcgagcggcacgggacgacgcgcccgtgttgcaccggcgcccgcccggacggcgggcgccggcttcaaccggtcgcgccggctacgcgttcgtccatgggccggcgccctgccgatactggatcacgccgccgttgatccgcacccgcaggttgccgtccggcagctgcacccagttctgcatgtcgaggctcagcatcagcgcggcgaagaaatcccgcagttgttgcgactcgctggcctgccagagatcgatgcgtccgaggcaggtacgcaggtcgccgctctgctgcatgatcgtctcgacctgcccggccacgttcgccgacgggtcgtacaccttcgtaccgtcgtcgctgacgatcgacagatggatcgcgcgcaccgacgccggctggcccggcgtctgctcgacgagcgcgatgcagctcgtcatcgcgccgaaatcgatttccgacgcatctccccagatgcgctcgccaaccgccagcggcgcgggaccttgtacgttctgaatgtcgtagggcatgggttcctcacttgactcgatgggactgccggtggcgggaacgacgcgtgtccgggaaagcggacacgcgtcgttcccgctcacatcccgcgacgggcctgacggcccggcgggtcgtgtcgattgattcctggtcgccgcgcgcggtcgcgcgctacgcacccttcttgtccagcagcgcctgataccgctgcaggctctcgtcgatcttgtcgagcgcgacgctcgcggcctcgccttcgatcgcctccgcggcacccgcgacgaccgccgccgtcgcgacgaacaggtcggtcaacagcaggcccaccgcatccatcgccatcccgcgcacgttctcgtcgatggtcttctgcgccagatccttcatcagcacgctcttgcccgcgatcgccagcgacgtcgacgcctcgaagtagttggccgccgcctgcgcgaccatcccgcccgcctgcgtgatcatcatgttcgggccgacggcgatctgcgtcgtcgcgtaggacgccgcctccgcgttgatcgcctgcacggtctgcagcgccgaaccgccgcccccggccggatcggcgacctggttcggcgccttcagcgcatcggtgagcctgcgcagccggttgaccggccatgcgcgcgcgcctgctttcggcgacgcgacgggcggcgcgacatcggcgggcgtcgttgcacctgctgccgcggacgcgccatcgtgcggcgcctgcggcgcaccgtcgccgcgtccgcccaaaaggcctttcatgttcatggttcaggtatcccgagagtcgactaatgcgtggaacccgtctgcggcccggccgccggcgcttgcgccgcgccgcccgctgccggcttcggcgacgcctcgacggacaggatcatggccaccgccttcgacacgacggcgttcgaaatctggttcagcgccgcctgctgctgcgtcatgttctgcgccgagatgccgacggcctggctgaacatctggtaaagcatgcccagcgcctgggccggggatcccgcgacgacgttgacattggtctgcgtcagcgcgtcggtaacctgctcattgactttgtctgccacgaggcctcctcggatctcggctccggcatgcgattgaaggaacggcaagccatcgacgccgcgcatgccgttaggaacgctgcatgcccgcgttcgtgaacgcgctcacgcgagttcctcgcgcaatttcctgcgcagcagctcgacacgcttcctggccagcggctcgttgatcccgagcgtcgccgcgatgtgcagatagggccggtcctcctcgaacttcagcgtgaacagcatctgctgctgcgaggagagcgttgacagcacctgctcgagacgcagcagctgttgccggagcagcagctgctgctccaccgacggcgcgtggccggccagctcgacggtgtgatcgtcgtcccagcccgggtcgaattcgagcatgccgctttcgcgcacacggcggcgcgcgccgtcgaggaacgcgtggttcagcgccagaaagagaaagccggccaggtttcggacgcgttcgggcgaacgttgcaggtagatgtggaccttgagcgcggtatcggagagcagttcgtcggcacggtggatatcgcccttgcacaacaggcgcgcgcggcgccgcaatttccctgcatttcccgccacgtgtgatcgagctgctgcgccggcgactcaggcgtcgaaacagcgtgctggttcgaggttgtcatcccgtgccttccttttttatggaaaacacagaatcgattcgacgccgggaatgacgctgttacccgcgtaacaccgttttaaagataatcgtttcgtgtaaattttcttgattattgtgaacggaaactttaattccccggcatatcctcatccgtcgtttcgggcgcgccgccgagcgtaaccaatggcatttcgatgaaaaatggcgactgccgccgcgacgtgattacgccggcacgctgctgtcgatgtcggtcgaccaaaggtccctggcgccgaagcaaaaccgtatcgggatcgctttcccattatctggttattttcatcattcatttttcacgcaatgccaaaggcagcgtttttcgctaggtggccgcatcgtcaaacaaccttgcacggaaaacatgcctgccctcgtcaacggtcgaacgctgtgcaatatcccgatactcgccgatcttccggaaagcctgctcgctcacatcgagcggcatctcgcgccctggcccgaacacggcaatcgcctgttgttcttcaagggcgatccgggcgatttcgtcgccttcgtgcactgcggccgcgtgtacaagacgctgcacgaacccggcggacgcgaactcattctcggccactcgttgccgggcgaactcatcggcgaaaacacgctggttcgcgcccaccggcgcagcttcaccgcgcagttgagccccgactgccgcgtgtcgctgctgcatcgccagtacttcgcgccgctgctggccaacgcggatttcatggagcgcatccacgagcagctgtgccggcacgtccaccagctgagcgacttcgtcgaatcgacgtgcctgtaccggctcgaagccaggctcgcgcgccatctgctgaaccgcatgcaagggaacgatctcgaggtgaggctgccggagagccagagcatcctcgccgcgatgctcaacgtcagccggccgcgactgaacagcagcctgcagaagatgcagcgcgacggcctgatccggcttcacgcgcacggcgtgacgatcgaaaaaccggagcagctgcggaccatcgtcaacgccaattgacgcgccaggcgcatgcgccgcgacgccgcggcggcaggaggtcgcgcgcgccgggttgcgcggcgcgcggtgaagatcagccgcgccagtggccgatggcgttcatcaactgcgcgacggcggtcagttgcgatccaaagttgtcgttcgcggagcgcgccgcggcggccaccgccaccggcgagccggcgtagagctgcatgacaccgacggtcgtggcggcgaggttggacatcgcctggttcgcctgcatctgcactgcgttgtgaagcaggatcgcggacgcatggctgttcgactgcatgagcgtgcccaaggccacggcgggcgcttcgcccaccaccttgacgttggcttgcgtgaccgcatcggtcaccgcggcggaaacctgttccggcatgtcgttgctcctggtttgcccgccgctgcgatgcaatcgcggcgaacgcatgaatgggtcggtcggcgacgtgcgccgatcgattgcatcggtgcgcgcgaacgctcgccgtcgcgagcgtcgggatgacgacaggcgccgggcggcagccgcgaggatcgggccgccgcccggcgtcgacgccgggttacgcgtcaggccagcgccttgccgagcgcgagcacatcggccagcacggacagcacgccgttcgagccgatttccgtcgcggcggcgccggcgctcgccggcccgagcgtgtagagctgcatcgtgcccacgttcgtcgaggtcggcagctgtaccgcggcctgcgactgctgctgcacggcgttctcgaacagcacgctgagcgaatggctctgggcctggtacagcgagcccgttgccatcgccggcgcttcacccaccaccttgacgttggtctgcgtgacggcgtcggtgatcgcggcattgaccgcgcacgtcttgcagttgcaggggtctttcggatccttcgaatccgtcggggcgcttgtatcatttgccatcgaatttctcctggtttgcgaacgggcgccgcatcgaatcggctctacccgtcctgtcgtttgctccggaacaccgcgcggcaccgctgttcaggcgccggcggacgtgctgcggttcggcggcgcggcggcccgagccgcttgcgccgccgctcgaccgcggcgtggcgaccgcgcgttacgggcgcatcgccttcccgatcgcgatcacgtcggccagaatggaaatgatcccgttcgcgccgatttccgtggcggccgcccccgcgctttccggcccgatcgtgtagagctgcatcgtccccacgttcgtcgacgtctgcgactggatcgcggcctgcgactgctgctgcaccgcgttctcgaacaggatgctgagcgaatggctctgggcctggtacagcgagcccatcgccatcgccggcgcctcggcgaccaccttgacgttgacctgcgtgacggcatcggtaatcgcgggattgacctggcacacctgacacgtatcacccatttttgctccttgattcacgtagttgagaggtcgcacatcgggggccggccggtctcgcgtccagccgccggacttcagccgctcgacttcaaccgcatgcccggtgtgctactccatggacgctggcccggggtatcgtgaacagaagcggcggcggcggtgacggcagcggccggttcgtgcagctcggccggacgggcgccgatgcgttgcagccgctcgtcgatcgcgtcgagccgcacggcgagccgttcggcgagcgaatcgacgtagtgccggaagcaggcgtcgatttcctgccggatgaggccggtcagctgttcgccgatcaccgccagcgcctcacgggtgctgtcctggatgtcggccgcgccggatgccggtgcgtcgtccggcggctcgtgcgcgtcgagtacgccggacaccttctgctgttccgacgccagcatgccgagggtcgtctcgttctgcgcgtcgatcgtctgcaggatgccgcgcatcttctcgtacgccttctgctggttgagctgcagaaagtgcttgacctgctcgcgcgcctcctgccgggttttcaagcgcggcaatggcgggttcgcggcgctcgcctgcgtggccgcgccggccgccggggccggctgggccgcgtgacgacccggcagccgctcgagcagcgcccgttcttcagtcggctcgagggccgtcccaatcgcttctccgcgaactgccgcagcaacgggtcgagtgcgtcgtcgctcatggctcacacctcctcgaggtcggcccgcgtcgccggtgcgtgcggttcgggtgcggatggacgcggcgccggggcgccaacgccggcgtactgcaatggatatcgcatggtgttctccgggaaatggacaggcggcggccctgccggaaatttcggcaggaccgctgcagggacgaaccgtgcgacgggtctgtgaaatcggttgtcgccgtgcgtcgcgcctacgccggcgggccatgcgcaggcaagcagcgcccccgcatgccggccgataccgttgcgccccgttcgcccgctgcccggtgcgtggtctcttttattgaaatcggcctacgccacgatcatgttccgccgaattcgatctccaacctgtttttgccatcctaagtaatctggccgttcttgtttcgcaagcggcctttcaacgactcctctgcgagggcggctcgatcgctcagggcgtagaacgccagcatgctgacgagcatcgcaaaggccacgccgctcgtatcccagcgcagccccacgctgaacgccattgccctgatcgcggtcatgccgagtgccatgacgagcaacatccccgcgaattcgagcgcgacccgcaccggcgccatgacgagcacgcgtaccgggccgcgtcgatgcccgtccttgcggtcggcttcgcgccgaatcaacagcgccagcatggccagcatcgacatcgggaaccactggagatggagcacgagcatgttccacatggcaccggtatcgagcgtgccgccgcagatgtcgagaatggcctcgaggggcgcccgcatcgcatcgagcgtcaatcccgcgcagatggcggccatgcaccagagcatcgaccggcgcgcgcacctgcccggcgatccgcctctcgtcgcgtaccccgccacgccgcaggcaaacgcaccgatgccgttccatatccagctggaaggggcaccatgcagccgcgtcggcaggtcgcacgccaggtagccgaggatcgcgaacaccagcgcgccgcgcacgcgttcgggcatcgggagcatggccgttcgcgcagccccggcctccacgcatgcgcggatcgcgcccgtcaccgtcgccggacgcccggccgggccggccggcggagcactcggggcagtcatggccgttcaggcgggatctcgcatgaccgcgtaccacgagcacaccaccccggccggcgcgacgccgccgttgccgctcgcatgcggaaccgtccggacgatcgagccggtcagcgccggacgctggttgatgccgttgggccagggcgcgctcacgtacccgacatagtcgtagacccactcctcgccgctgaccacgccgcgcccctggaagcggacggtgccgggattcccgtagctgatccacccgttgagctgcagctcccatcccgggccgaaaatgcgccccttgaagatgcccgccggtgcctgcgcgatctcgatcgtgccgaggccgaattccaggtcgttgaatgcggtggccgggtcgggatcgttcaggaaactgcgataggtccactggcccaccaggctgccggtttcgggtgtgtagctcatgcgcgcgtctcccttcatgtccatgtcgtcgaattaccgaagtgaaccggcgccacgcgatggcgccggttcgtcacgcgccgtcgttaccggacctcgagccggaacagtttcggcgcggcttgcggagccgcaccggcgacggcttgcgaagcgggcggcgaagccggttgtgtctgcaggcgtacgccttcgcgcgtatggatctcgacgtcgtactgggcccctccactgcactcaccgagaactggtccagcggaaagaacgccttcacttcgaggtgcgtctggcagttcgcgcagtactgcacgctccagcggctcagcacggcctccgtgccgagcaggtgccgctcgccgtccacgttgacgtacgcggagaccaggaacgatcccgcgatcggcgcacgattcagcccggacacgcgcacgaccttgctgctgttgccggccggcacggtcgtcgccgccagcgagagcttcggcaggtcttccagcgaaccggggccgtacgtgtagccgagctgctcctcgatattgatgcagtcgagcgacgtataggcgcgctccttgccgttctcgctcttcttgaacggatcgagcggcgacgagagcgtgagccacgagttgggcaccgtgcccggcgtcggcccctgcgcgtcgaccgagttggtgcccggatactcggcgatgacgtcgagatgctgcgtaaagccgtgccgcttctgccacagccagaacacgcgatcgatgaagcagtgatggaaatagaagatcgggtcgaggcccgccgtgtcgttttcgcccatgtcgccgttggcgcccggaatcggcgagaggtcgcccttgttcgggccgtgcggcacgtcgaacccgccgaccgccaggtgaatcttgttgtgcggcgactcgagcgggacgacgggaatcgcgccttccggcagattctcgttccactgggccgcggacgtcgtgttggaaaacaccgtgtagttcggcgcgtccaggcactgctcgaacttgcgcttcacgttggtcggcaccaccttgcccttcacgacgatgtaggacgtgagccagtccacgatgttccggttcagcaataccacgttctccttggcatccttgaacttggcgttgtgcttctcggtcgcggcccggtccttgtcggtacccacgagccccgacagcgggtagcgaaccgtgacgtaaggcagcggcttgctgtagttcggatcgtcgccgttgatgttgtcggtgatcgcccggttgaacgtgaaggaggccagcggattcggaatcttttcgccgtcgagctcgaaatccgggtcggtcagggcccacgggatgcctttcgtcagcgactcttcgctggtttcgtcccagaacggcagcatcacctgctcgcaaccggggatgctctgcagcgcctgttccagccgcagcaggtacgcacggtgccaggtggggaacagcacgtttccgtggttgcaatagccgccccagtaagacgccgagccccagccggcgccgcggaacggctcgccgtggaagccgccgatcatgaagaacgagttcggatcgtcgggcggcaatgccttgatgcctttccacgcgcgcatcaggtcttccagcggcttttgttgcctttcagatattcgacttgcaacgattcgatcgacggacgaactctgactccagatgcgttattcatgatatatccagcctccttcgtgggtagcattagggcttggccgccaggttttgaacgtaagcaggtagttaataaagcatttaaactcgcgctcaatcgaattcgttttattcaaatatcgcgtatcattttgaaagcattaatcggcgggccatgggcgggcccgcgtggccacctgatcgcctccatgggcgcggacacgcgcaacaggcgtagcacgcccgctggaaaggggctgcgccttcagatcgtagggatgccgtggtgagtcgatgccacttcgtcaggcaccaatacctgacgaagtgactgtgataccccgatagcgttttatcctgatttggtatgagtaaataaagcagatggaattggttttagcaaggtcaaggcgaccttgaatctcaaaaaattcgaaggcgaaaatgatgattgacccgtttaattttcttaaataatcacacccatttacgacgcgagagtaaaaacaggctcgggataatcacgggagcgcgacgatgttgacgaatgcaatcgaccgaaagaaaccttacggttgtcagttgccacgtatgcggctgaaagctcgtggaaaacgggcaaggtcgtatcgcggcatctggacgacgctatcccgagccggtagcgtcacggccattcgacgcgcccctgcggccctgtccccgacaattcttgactgtgtccgcgccgccgagctggtaggatgccggtcgcctcggcatggatggcagccaaagggcgttcaaccgtcccttttatgcccgccagcggccaacccgccgtcccgcccgggcgacacggtgcccggtcgcaccccagccccgtcgaaccccgcaacaccccggcgtcgcctcacccgacccgttgcagcaaccgttggagtggcgcctcgcgcgccagcaagcatgaagaactcgaagccgcccacccgcctcccgcgcgagaaagaccgtacgccgctggtacgcgccggcgcgctgctgctgatggccggcctgctgtacctgctgtggccgtcggccgaaaccgcctaccttgcgatggagtccgtcatccgctgacgcggcacgtccgtccccgctctacgctatactcgcgcaatggaaacccaacccgcctcgccgaacgtgcattgctggtggcgcgcctgacccaggcggcccgtttcctttgcatgtcccaaacgtgatgccgccagccatggcggcatttgcgtttctgcgcagacgacatggctggcggcttcgataacccggagcaacgaccaacatgacccacccgacccgaccgatcatcctcaccggcgaccgcacgaccggcccgctgcacctcggccactacatcggctcgctgcgcgcgcgtgcagatgcagcacgaagcgaagcagttcctgctgctcgccgacacgcaggcgctgaccgacaacatgggccgccgccagcgcgtcaccgagaacgtgatcgaagtcgcgctcgactatctcgccgtcggcatcgatccggcgatctcgacgatcgtcgtgcagtctcaggtgcccgagctcgccgagctgtcgcaatacctgctcaacctcgtcacggtcgcgcgcctcgaacgcaacccgaccatcaaggaagagatccgcctgcgcggtttcgagcgcgacatcccggccggcttcctgacctacccggtgagccaggcggccgacatcaccgcgttcaaggcgacgcacgtgccggtcggcgacgaccagttgccgatgatcgagcagaccaacgaactcgtgcgccgcttcaacgcgacggtcgaccggcccgtgctggtcgaatgcgaggccgtgctgtcggcggtcacgcggctgccggggatcgacggcaaggcgaagatgagcaagtcgctcggcaacgcgatcacgctcggctcgacgccggacgagatcacgcaggccgtgaaggacatgtacacggacccgaaccacctgcgcgtgagcgatcccggccaggtcgagggcaatgtcgtgttcacgttcctcgatgcgttcgagcccgacgtgcagaaggtcgacgagttgaaggcgcactaccgtcgcggcgggctcggcgacagcgtcgtcaagcgcgtgctgaacgagcggctgcaggcgctgatcgagccgatccgcgcgcgccgccgcgaattcgaggccgacaaggccgaggtgatggcgatcctgaagcgcggcacgatgcacgcgcgggacgtggccggcgcgacgctcgcggaggtgaagggggcgatggggttgaactacttcgattgagcggcgcaggccgcgcgtgcgtaaacgcgccgcgcgccggacagtatcgggccggcgcgcggcgatcaccgcatcaggcgcgcgtgcgtgcgtcgctgcaaccgcctctcgtcacgatgcgtgcgccggcacggacgcgtggcacaccgcctctacccggttgccggccgggtcgacgagaaacgcccgtagtagtcgccgtgataatgcggccgcaagccgggctcaccgtcggacttccgcccgtcgcgaggccggcctcgaaaaacgcatccacctgcgcgcggctcgcggccttgaagcaccagtgccgcttgctcacgccgatttcgacgggatccaggtagatcgcgagaaaggtcgatgcggtgtcgttcgcattgcagcgttcgccgtagccgagtgcggtgccccggtcatagacccgggccgcgcccagcgcggccatgatggcatcgtagaacgggcgcgccagttcgatatccggcacgctgattgacacgtgatcaagcagttgcattgcatctactccgttgaagggcacacgagtctacatgagcgcgacaattcgcgccgaagccacgctgccgctcgtgggcaatacctgcacacccgacactgtcacacgcgatgtcgttcatggcggtagcgggccgtcccttggtccactccgccgatgccgcgcccgcgcaacccgctatcgtttcgcatgcgatccacggacgacgttcttccaactacatgcgtggagcacttcgaggtcggcggcccggtttcttgataggcttcatttcggcggctctcctgtccgggagcgcggtcctggaaacccgatccgcgcggattcccgcaggaaccgccgccttcaacctgcaactacttttgggactctgcccaatgtcggccgacgaatcgatacacgcgtacccggggaagcatccacgttcaattgtgcgtgttgtggtagcgagacgaggagaatcacgggcgaactgcaccaaggcgattcagtcgttggtgtccacttcgtccaatgggcgactggaaggccggaccatccgccgatcattgacctcgtgttgggcgattggggaaagcgccgggcctgccgaccgcgttctggtttcattgatctatattccgcgcgagggaggcggtcctgtctccgtcgtgaacgccgcggaacggggtgtcgataattccggcttgtttgaagtcgcgcttgcccgggagcaggtcatcggtacgccgctggccccgttggcgtttcagatgatcgatgcgctctggatcaccgagccacgaatcgcagaggtcaaagcactggacaacgtcgtgcagatcaacctcgagaggcgcggcgtcacttcatctgcatcagttgaatcaggttcccgcaggtatcgtcgacgatcgcgacgcgcacaggccccgcgtccatcggctccagcgtgaagcggacgtcgagatccctgagccgcgcgaattccgcatcgagatcgtcgacctggaacgatgccgccggaatgccgtcctcgtacagcgcctgcttgtaaggcccgaccgcgcgatggttgctcggctcgagcagcagctcggtgccgtccggctggtccttcgacaccacggtcagccagcggtacccgcccaccggcacgttgtttttcagcttgaacccgagcttgtcggtatagaacgtcaacgccttgtcctggtcgtcgacaaaaatactcgtcacgtagattcgcatttcaacctctcctgacatagcagccgtcgccgccgctattcttcgtcgaaatcgatgacaaacgcataaccgccgtcgatcagctggcgcaggtagccgtcgaagtcgtcggcgatcaccgcgtagctgtcgggatcgtgcaggaagcgcacgacctgcccgaccttgccgcccgccgccggctcgaagtcgatgtagagctgcgacgtgccgccgttgttcatgcaatgcgagaagcacagccgccggcccatcggcagcgcgatgtcgatgcgtggatcgacgagttcgccgtcgtcgttcgcgtcgtcgccgtagatctcggcgatgctgtcgcggtacttcgccccttcctcgagcatctgcgcggccgacagcaggtaatacgggtattcgtagacgtcggagcccagcaccagcacgttgaccgtcgtgccgccgtagtcgcgccagtaggtgccgtcgagcgtgccgagcagttcgagcaggctggccgggcactgcggatacgcggcacgcagcgcgtcgagctgcgcgggcgtcgcgcccgtggcggcggcgagcgccgcgttgtcggtgtcgggcagcacggcacgcaggccggcgagataggtgtcgacgagggtcatcgcgtcagatccgaagaacaggccagcgccattctagcgcccgacgcgacccgccccttcagcttcttccgcgcacccgcctatgtgatctggtaagtcgacgccggcacgaattcctccggcagcgggcgatcgcccagttcgagcaccgatcgttcgatcgtgcgcgccatcgcatcgagcgccagcgcgttcggcgcgaggccgaacggctcggcgacctcgttcgcgatcgcctcgagtgcgatcagcgtgtacgcgatgaacacgcagatcagcggcgtgaagaactccgtcgaatcgacgagaccgaacggcagcagcacgcaatacgcatacacggtgcgatgcagcagcacgctgtacgagaacgggatcggcgtcgacaagatgcgctcgcaaccgccgaccgatttgccgagctcgtcgagttgcgcctcgaacatccagcaggtcgcgtcgctgcctggcgcgcggcccagcgcgcggacgatgctgccgcgcagctcgtcgaggatcgccacgggcttgaaacacttgcccgcgagcgcggcggtgcgctccgcgccgaggatccgctgcaggtcctgcgtcggatcggtatggcgaagctgatgcttcagcgcataggtgaacgcgatcagcaggtcggcaagccggttgcgctcggcgtcgtcgacgctgtcgggcaggtagcgattcagttgcgacgtcagcgcgcgcgccgcgatcagcaggttgccccacagatgccgcgcctccttgaaccgctcgaagctcgcgttgttgcgaaacgcgaggaagatcgcgagcgccagcccgaacagcgtgaacggcgcggtattgagggaatcttctcgccgaagatgcgcccgttcgtgaagaccgccagcgtgctgacgatcgccatgaacacgagctgcggaatgatcgattgcagcacggagccgttccagacgaacagcatcctgagccagttttgtcgtggtcggacgatcatggtgttttctcgactgccagggaaatacgcgatacggcacgccggcgcccgatgcgcagcggcccgcgcgtggcgggccgctgtcgggtggatgccgggccgggcgccgtgctgcgcgagatgatacgcccgcgcgcgccgcgcccgtcacatcatgcggcgctcagtgataaccgacatcgccctcgcgcaccttgccgcggaacacgcggtactgcatcgcgttgtacacgaggatgatcggcagcacgatcacggtgccgatcagcgcgaacttctggctcgaatggctcgacgatgcatcccagatcgacagcgacggcggcacgatgttcggccagatgctgatcacgagccccgtgtagccgaggaacacgagcgcgagcgtcagcaggaacggcgtggcctcgtgcgtgcgcttcaccgagtggaagatgccccacacgcacgcgatgacgaggatcggcaccggcaggaaccagccgaggttgccgctgccaaaccagcggtgcgcgacggccggcagcccgatcacggtccacaggctgaccacgcccatcacggcgagcagcacgcccgcgagcggcttcatcagcagccgcatcttgcgctgcagctcgccgtcgaccttcaggatcagccagccgcagccgagcgtcgcatacgtgacgagcacgccgatcccgcacatcaggctgaacggcgacagccagtcgaacggcccgcccgcgaactggttgttcacgatcttgatcccctgcagcagcgaaccgagcacgatccctggcagaacgccgcgagcgcggagccgccgatgaacgcgagatcccacatgtgttgcgtgcgggtggccttcgcgcgcagctcgaacgccgcgccgcgaaagatcagcccgaccagcatcaggaccagcggcaggtagttcgcgggcagcagcgtcgaatagacgaccgggaacgcgccgtagagccccgcgccgccgagcaccaggaacgtctcgttgccgtcccacaccggcgcgacggtgtcgagcatcacctggcgctcggccttcgcatcgaagaacggaaacagcaggccgatgccgagatcgaaaccgtccagcatcacgtagatgaatacaccgaggccgatgatcgcggcccacacgacaggaagatcgatttgcatggcttactccgcttcggtcacgttcagcggcgtggacagcgcgctcttgcgcagccccggatgccggtgcagctcgatatacccggcctgggcagccggcccgcgcttcatcagtttcagcatgtagtagacacccgttccgaacaccaggaaatacacgaccacgaagatcaggagcgacacgccgacctgctgcgcgctgagcggcgcgacggaatcgacggtgcgcagcacgccgtacacggtccacggctgccgcccgacctcggtcgtgatccagccggccagcagcgcgacgatgcccgacggccccatcgccaccacgaaccactggaaccagcgcgtttcataaaggcgcccgccctttctcaacagcaacccgagcagcgcggtgagcagcatcagcatcccgaggccggccatgatccggaacgtccagaagatgatcggcgaatacgggcggtcctgcggcgggaattccttcagcccgcgaatctcgccgtcccagctgtgggtgaggatcaggctgccgaggtgcggcacctggatcgcatagcgcgtggtttcggcctgcatgtcgggcagcccgacgaggttcagcgcggtgccgcccttctcggtttcccacagccctcgatcgccgcgatcttcgccggctggtattcgcgcgtgttcagcccgtgcgcgtcgccgacgacgatctggatcggcgcgagcaccagcagcatccacagcgccatcgagaagctgcgcttcaccggctcgtcgcggcgccccttcagcaggtgccacgcgccgcacgcggcgacgatgaagcccgcgacgatgaacgccgcgatcgtcatgtgcacgagacggtacggaaacgacgggttgaacacgatcttgaaccagtcgaccggcacgacgaggccgttctcgatcttgtagccctgcggcgtctgcatgaagctgttcgacgcgaggatccagaacgtcgagatcagcgtgccgaccgcgaccatcagcgtcgcgaagaagtgggcgcgcgggctcacgcgctgccagccgaacagcatcacgccgaggaagccggcttcgaggaagaacgccgtcagcacttcataggtgagcagcgggcccgtgatgttgcccgcgacgcgcgagaagccggcccagttcgtgccgaattcgtacgccatcacgacgccggagaccacgcccatcccgaagccgatcgcgaagatcttcgaccagaactggaacatggatttgtaggcggcgtcgccggtgacgagatagcgccattccagcaccgccaggaagctcgccataccgatgctgatcgcgggaaacacgatgtggaacgacaccgtgaatgcgaattgcaatcgtgcgagatggaacgcatcgaagatttccatgaccgtaatttgctcgtgtttgtgaggatgtccgcccgaagcaggaaatcgcgcgacggcttgccgacgacacatgcgaatacaaaacggtcactcgcatggcatcgaagcgtgaatgacgatatcgcgtttgcaacgatactcgcaatcgttcgaacgtgcgctgaaactgtgctgcttccgttgccgaagatgtgtgtacggaaaacacatttcgcgccggcgggacgatcagctgtactgctttccgcactgcagcgctgtacatcgggcgcactgttcatccccgttaacatccgatgcaatgcctgcccgcggtcacggcgcgccctcggccgcgcccgcccggcagccccgattcccctggtccggcgtacgcgcccgacccggccggcccgccggccgatccgcctggagaacccgcatggagtcctgcatccgccgcgacgagccgaccggcagcaccgcgtgtcatgtgacacgtcaccgtgccggcgaagtgcgcgataccgtcgatcgcgtcgtcgacgaaacgccggttgcactcgtggtcaacggtattgcacacacggtcatgatggcgaccccgatcgacctcgacgcgttcggcttcggcttcgtgctcagcgaaggcatcgtcgagcgtgcgtcggacgtattcgacatcgagagcgaatgccggcccggcagcgccgaagtgcgcctgaccgtgtcgcagcaggcgttcatggcgctgaaggcgcaccgacgcgcgctggccggccgcacgggctgcggtgtctgcgggatcgaaagcatcgcgcagctcgacctgcacccgccgcgcatcgccgccgccggcgcggccgccggcatcggcgccgacgcgatcgcacgcgccgcgcgcacgctgccggcccatcagacgctgatgcgcgagaccggcggtatccacgcggccgcctggtgcgaccgggacggcgccgtgctcgacgtgttcgaggacgtcggccgccacaacgcgctcgacaagctgatcggccggctcgcgcggcgccgcgccgacctgcacgacggcttcgtgttcctgtcgagccgcgcgagctacgaactggtgcgcaaggccgcgcgggtcggcatcccgatgatcgcgacgatctcggcgccgacgtcgctcgcgatcgacgtcgcccgcgaagccggcgtgcggctgctcggcttctgccgcaacgacggcttcgtcgagtacgtgtcgcccgatgccgttcaccccgaccaaccggcgcttgcgcaagcacaccggacttctcctgatgaaaccactgaccgatttcgataccgctcagcagcatttcgcgagcgcgttcgcgccgctcggggccaccctgtccgtcccggtcgccgaagcggcaggccacgtgctggccgcgccgctcaccgccgtgctcgaccagccgccggccgaccagagtgcgatggacggctacgccgtgcgtcacgcggatctcgcactcggtgagccgctgcacgtcgcgcaacgctgttatgcaggcgacatgccggcgccgctggccccgcgcacggccgcgcgcctcttcaccggcagcctgattccgcccggcgcggacaccgtcgtgatgcaggagcatgcgcacgagcaggacggccgggtcgcgttcgacgcgccgcagcgcagcggctcgcacatccgccgccggggcgaggaagtgcgcaccggcgacctgctcgtgccggccggcgtgcgcatgggcgcgatgcatatcggcgtggccgccgcgcaagggttcgcgcgtatcgacgtgcgtccggcgctgcgcgtcggcgtcctgacgaccggcgacgaactcgtcgcgtgcggccagccgcgcgcgccgcaacagatttacaacagcaatgcgccgatgctcggcgcgctggtctcgggcaccggcgccgaggtcgcgatgagcctgcatgccgccgacaccgcgcccgccgtcgatcgcgcgctgcgcgatctgcacgcgggctgcgacctggtgatctgcgtcggcggcgcgtcggtcggcgacaaggatctgctgcgcccgcgctggacgcactcggcgcatcgttcatcgtcgccggcgtgcgcatgaagcccggcaagccggttgcactcgcgcggctcgacacgcggccggtggtgctgctgcccggcaaccccggcgcggcgatgaccgcgttcgcgctgttcgtcgcgccgctgatccgccgcctgcaggggcgcgccgcacgcctgccgatcgtgccgtcgctgccgatcgacggcgacttcgaaccggatgcgcagcgcgagcgcttcgtgcgcgtgcactgcacggtcggcctcgacggcatgcccgtcctcgatacgctgcgccagcaaggcgccggcacgctgcagtcgctcgtgcaggcgagcgggctggcccggctgccggccgggcggcgcatcgcgaacggcgacgcggtaccgtattacgaattcgcgccgtggctcgcatgagcgcgacgcccgacacgcgcccgctgccgctgccgcgcatgcgccgcgcgtcccgcgccgcgaactgtattcctgcaattcgggcgcgattgtgtccctgccggaaaaacccggcggactatcctcacgatgaggctcgtcacgcgccgtgcgccgccatttcggcatgcgcacggccgaccggcgctgccccttcgcttacttcatgcaggccgacgaaccgatcgtgaatgccatcgtttccgccgcgccggccgccgccgcagcttccggcggcgcatcgcccggcgccttccccgcccgaccgacacgctcggccgcccgctgcgcgacctgcgcctgtccgtcatcgaccagtgcaatttccgctgcggttactgcatgccgcgcgaaagcttcggcgccgactatgcgttcatgccgtcgtccgagcggctgtcgttcacgcaactggaaaagatcgcccgcgcgttcacgtcgctcggcgtcgaaaagatccgcatcacgggcggcgagccgctgctgcgccgcaacctcgaagcgctgatcgaacgcctcgccgcgctgacgaccgtcgacggcaagcccgtcgaaatcgcgctgacgaccaacggctcgctgctggccgcgaaagcgcgttcgctgcgcgacgcgggcctgtcgcgcgtgaccgtcagcctcgatgccctcgacgacgcgatgttccgccggatgagcgacgccgacgtgcccgtgtcgcgcgtgctggccggcatcgaggccgcgcaggcggccggactcgcgccggtcaaggtcaacgcggtgatcgagcgcggggtgaacgacgaccagatcctgccgctcgtgcggcacttccggcataccggcgtggccgtgcgtttcatcgaatacatggatgtcggcggcgcgagcttctggtcgggcgacaaggtcgtgccggccgcgcagatgcgcgcgctgatcgatgcgcactatccgctcgtgctcgtcggcgaaccggcgcacgatgcgaccgcgatccgttgcgcgcacatcgacggtgctggcgaggtcggcttcatcgcgagcgtgtcgcatccgttctgcggcacctgttcgcgcgcccgcgtgtcggccgacggcacactctatacgtgcctgttcgcgacgcaaggcaccgacctgcggccgtggctcgacgaagcagcgtcgagcgccgacctcgccgccgccgtgcgcgatcgctggacgcaccgcgacgaccgctattccgagcgccgggccgcgcggccagcccgcgtgccgggcaagacctatccgaccgtgcgcatgtcgctcgtcggcggctgagcgccgccgcgcgacaccgcacgcgccgccaaatggagaaccagtcatgacgaccttcaccgaatccctgccgggctgccggacgatccgttgcgtgccggcggccacccgcctcccgtcgatgcggccgacccgcaccacgaaccgccgcccgcgatcaccgccggcttcgaagtgcgcgtgcagtacgcgccgatcgacgcaggcgcagagcttgcgccgatcgttcgcaatccgaatgtcggcgcggtcgtgaattttctcggggtcgtgcgtaacgaaggtgatgtcgacgatgtcgtcgcgctcgaggtcgagcactacccgacgatgaccgagcaggccctgtggagcatcgtcgaggaagccagtgcgcgctggcagctcgaagcggtgaagatcgtgcatcgcgtcgggcgtatcccgctcggccaggccgtcgtgctggtcgtggtggccgccgcgcatcgcgcgtgtgcgttcgatgcgtgcgaattcctgatggacttcctgaagacccacgcgccgttctggaagaaggagatccggcacgacggcgaatccggctgggtcgaggcgaaggcgcacgacgaccaggcgatgcggcgctggggctgagccggtccgccgcgcgcttttcgattccgccgactccattcaagacatcgcaatgaaactgacgatcaaatactttgcaagcattcgcgaacaactcgagcgcgacgaggaaaccgtcgaggtcgacgcacgcgaactcaccgtcgacgcgctgcgcagcacgctggccgcgcgcgacgcccgcagcgcggacgcgctgcggatggaccggcccgtgcgcgcggccgtcaacctcgagatggtgacgggtgaattcgtcgtgcgggaggacagcgaggtcgcgtttttccgccggtgacgggcgggtgacgtcgcgacgggtgggatccctccggtgccggatacgggccggcgcgtgtcggctgcttgcccttcgcgatacagattccgggttccgcgtttgatggcccttgattccccgcaccatcgccgcggcgcacattctctttgaagcggtagtagaccatcccgatcagggaattcttgttccgatcggcccgaggatatttgctgaacgtgaacaggtaccgtaggtgagccgactgacccggtggccgtccaggcacatggagccgacgcgctggtcgagcacgtcgcattcgtaccgccacaccgcgaccagctatggtgccgcgaagtgtgcgccggtgtggagaccgtggccgcgaaaccgcgtttgaacctggaccgcggcagccggaaacctcagtcttccatgcccgggacaacggtcgagaaacctgcgtccacatgggtaatctccccgtcacgccagcagccaggtcagacaacaggaaagcggcaacattgcctacatcttcggtggtcacgttgcgacgtagcggggcatgggcttcgacgaacttcaggatggccgagaagtccttgatgccgctggcggccagggttttgattgggccagccgagataccgttggcgcggataccgcgtgaaccaagggcggaggccaaatagcgcacgctggattccaacgaagctttggcaaggcccatggtgttgtagttcggaaccacgcgcttggcaccgaggtaggtcagcgtcagaaccgacgcactgcggcctcccatcaacggcagcgcagccttggccatcgcggcgaaactataggccgagatgtcgtgcgtcatacgaaaaccctcgcgcggcaagccatcgaggaagttgccggcaatggcttcgcgcggcgcgaagccgatcgagtgcgccagaccgtccaggccgttccagtacttgcccagcccaacaaaggccgcgtcgatctggcaatcttctgctacatcaccgggcagcacgattcggctgccgaattcagcggcaaattcgctcacgcgatccttgaagcgatcacccgcgtaagtgaaggcgagttcggcaccctgctggtggcaggcctgcgcgatgccgtacgcgatggaacggctggagaacaccctcggtgaccaggatatgcttgccggtaagaaaacccatatgtgtctccttttgatttgaagtgcgcgctcagcccacgctgccctgcgagccgctggcgatcaggctggcgccgcaggcggttttcgtgttgtgcagcgccaccggcacgccgtcaatgtcatagttggggctgccctcggcgatggggaaaacgcccttgcatttggggcagctcaccaggtgcccaaggcctgcgatcttccggccgttgaggtcggtgttggcaaagccctgcataaccacgccgccgtggttggtcatgtcgccttcgcggacgatgtcttgcatattcactcccgttagatttgaccgtgccaaggcggcacggcatggactctcgcgacacggaaaaccaggttggtccggtgcgtcactggtggtgtttgaattgttcgatcaactgacgcgccgtatcatcattcagccgcatatctcctgtggccgagaactcgtcgccgtagagcgactcgtacttgatctcaattacgatactgttgtcggcgagcaacttcatcatctgtacatggcacgctggattcgccagccccgacaccgtgaaaagaggaatctcctcacccgccttcacgacgctatcttgaacaggccaccccgtcctgaagcagtccgtcgcgcccaaccccaggtcagcacggaattgcggccaaatgctgcggcccagcccggtgtatctcctgtcgcccaccgtgaccgtcatgctcttgatgatcgccgggccgagccccgcgttcgacaggtagataccgtactttcggctcgtgtcgtcgaagtattgcgtcgtgatcgcatacgggcgatacagcagcttgttggcggtatagttttcgtgggtagcccaagccgcccataggcccgcaccggcagacgcgaccgagatcgcggtggcaaaccccgccgtaagcaagcggtagaaaattctcttactcactggtttcctccatagcagtacccgatgcagcgcaaacggttcgctggcattcgctaggcccaccgccccctcgtcgggagtgatacctgtcccattcttgaacttatcctttccaaacttcgatttccccaccatcttttgcaggactcgtcaccctcacgggctcaccttcgcaatagtgaagatgacgaacactcttgattggccatttgtcactccgccatgcgcatgacataaaacaccattttcagatctacaagccgaaatacttacctcacccccatttcatgatgaaaatcctaatattcgcatccatagcaaatcaactttggatactacgcaaatcacaagatgctacacaccactcattcagctcataaaaattgccatccctcacttaactttgcccaacctcataaaatatgacaacaacaagatcaaatcagtttcagagaggtgatgccaccaacacaagcctgccatcaataaatcatgacgagtattttccttttaatttaaccaagaatgaaccgtcacatttctccgccaaaattccacccgctattcatttcacctacttcgttgcggcaaaactccagacaatattctttttccatttaatatttccagatcgacatcttccccaccagaccaaatgaccgcattagcaaatcattattagcaccttactcgacagacctctcccaaaggtcatcaatagcagatgccaattaattctctcaacaatcatcgaatctcttcaacatcagcaagaattggaatttttccacgcccgattttcaattccccgccaaatatctccaaataaatcctctaccctcaccccgcttctcgccgccattggatactagaaaacctcgccttcatccagagcagcatagaactgatcaaacaaattattaatagcattcgcacacatagtttatgactgaatccctagaagcaggaatagagggcgcactaaatccaccaaacattccacgctctccacacgcatccatacacctctgcctcgcagcatcaatgcttggcatcccacatttagtggcaaaaaagccataaccaatagagctaggcccgtatacatgaaaaacattcttgaagctttcataatcacaatcctgaaaaacatttttacacaacaaaacttgcgccccatttaattgaataatattgttcagtttttcagatccagaattgcccgttagttgatttttccagcaaatcatcttcacaaaaacctgaataacaatacgattcctgcgttctcaaccaaacgcccacaccagacaattcatcacataatttagcaacaatccaaggaaaatttgacacccctttaaaaactaccaacctgcgagatctgcgccactcccaccattggaagaaagatattctatcgatataaatttcccactccaatcggcccattttcttgaaaatccaatgaatcaatccgaatatttcatcataagatgcgactctctcctttctctgaaaaaccaaactccgtaagccaatcatattccgctcgctctagcgttcgctcgaatcgataccactcccattttgatcgctctttgataacccgcgaaagcccccacggaattacccttttcgacgactatacaatccagcccatcttttgaataaatcacattcacaaaaaataacgcaccaaacaaaagacgccccctaatagcacttgcacgtgtaattttcggccgtacttctcgtagaagtttggaaatggagcaaccagaacaccgaacctgtcgcgcttctaacaatcttcaacgcacatttttctttctcatccatagttggctcgctgcacttcgccaacaaaaacaatcccactagaattaaccacaaagtgcatccagccattttcacaaatcccttcatctcagcctcattaccgtgcagacaaacatttcctatccttctctttttccgaaaacgaccgcggcaaatttttcggcctagctttgcgagttatatttcaattatcgattgctgaccgattcaaacgaaaagcacgaccctacatatacctgcaaataaagagcagatcattattaggagttggatccaagaacggggcaaggtttactttggacgtgacgacccgtaaggaagtgaatttgactccgttcttcaattcagatctgcgggaattgtgctgaacagactgaggtcgaagtccgagtcacggaatcggtgtatggttccctccaaaaagttccggctctttcccttcaatggtccaactgccctgcatgtcatttcagccccactttttaaatgccgcatattcgacttgacatccaaccgataaacaaacccggatgttctcttgaaccaggctttgatcagcagccggacaacttgaaaaatctcaataacattcacatcgatattcttctattgtctggcgcggagagtaagatttattaggccacacaagtcttccgaatctctcgccttccctacactttcttacgcatcgctcaagaatctgtggatatgactcgcctcgtcttgtcgccattgaaaaagcaacccaaatataatcaaaaaaacaatgccaaagcaatttgagtcttaattccgattttcataaatcacccactttgtgcatgtgaattttctatcgtcgccatcagacgaaaccaatgcctgctttgatctttgataaactgccttgcagatccctccagagttatcggttatggatagctgcaattctccgtaataaccgtccgcacaatagcgattcaaattcggcatcaaccatggcacattgaccccaacccattcaccaggcaaaagatcattcttccagggaaaattcgaaacagcgtccaaagcggcacccaccgacccaattcgagcaatggacgataacgggggcgtagtgccggtccgatagagatgtcccatgccaagaagaactgggccggtcgcctgcaaacccaaaggatcaacccaagtcagcggattgcgaacgtacccgtaaacattaatcccacccacgagtccaatcgggtccttgctcacaaaccgccccacttctgggtcgtaatagcggtacctgttgtagtgcagcccagactcgtgatcgtgatactgcccctggaaacgaatcggattgcgcagttctacgccctcattcacaacattgcgaattacctctttcgccatgccccacgcactgtgctcagcgctccaggcaatgcctgcatcctggtcagtcagcacctgcggcgtaccgagatggtcacactggtaccaagccagactgtcgatggctggtgccggcggcggcggcagccagagcggatcgttgtcgcggagatagcgcgcaccgtagcgcggttcatcttgaagcaggatggcgtccgcgcgcaccgcctgcgccacgggcacgaaagtgccgggctcgtagacgtagtgcgtggtgcgcgcgccgaagccatcttcgtcggcaatgctgctttcccatgccagcgtgtcgccatcccacccgtagagcgtgaagccacactggtgctggcgattcaccttgaggcgctccgcgcgattccattgcgcgccggccccgcgccgctcttcgtagtgtgcccgggtgtgcttgtacaaccggcggccgagcgcatcgtagccatagtcggcttgcaggcgctcgtcttcgtagtgggtcagccggtcgaacaggtcccaggtgaagcggctctcctgcccgttcttccagcgctgggcgaggttgccccaggcgtcgtactggtagtgggtgccggcgtactgcttgagccggttgtccagcgccttcgggctcggcatgcgctgacgctcggcttcccgctgctcggccgggtcgatcaggttgccggctggatcgaaggcgaagatttcggtgcctaggcggctttgtgcctccagcaactggcctaccgggtcgtagccatagcgcagttcgccacgatgggtgtcgttgatgccagtcagctggctcgcagcgtcataccggtagcgacgcaccaggagccgaccgccgtcggtttgaccttgcggacctttcaagctatcgcgcgccagcacctgttcgctgaggcggcccagcgcatcccactgctgggtctgcaacaggcggttgccttgcaggcgcgcgacttcgcgatgcaagtcgtcgcgctcgtagctgaccagttcgtgatcatcgagttgcaggccgaccagatggccgctgccgtaggtgagccaactcacccggtggccgtccgggcgcacggtggcgatgcgctggttgagcgcgtcgtattcgtggagccacacggccaccagcggcttgcccaggctgcgatagtgctggtgctcgcgcaccaggttgcccgccgcgtcgtggaaccattgcaggcggctggctgcgttgctggccagcgccaggttgccgttgccatcgtaggcgaagcgctcgacttgccaatcagcgtcgcgcgggatggattctccaatttgcagcgcggcgcgtcgctcgatgaggcgccctctcgtcgaaacggtaggcggtgatgcgctgtccgtcgacggtactcgacaggtgcccgctgcgcaggtcgtactcgtagtgggtagtggcgccgtcgaagccggtctccgccagcaagcggccgaccgggtcgtagcggaactcggtgtctcggccgttctggttacgcagacgcacgagtcgacccagtttgtcccagtggtagtgcacggcctggtcgctggcgtcgacgcgctggcccagcagacccgctgcggtatagctccaccgggtacggcggcccagcggatcggtgtagacgaggagccggccttcggcatcgcgctcgaaccggtgttcggtgttgtcggagaactgcgccgcagcgagttgtcccgcctcgtagcggtagcgggtgacgttgcccgccgcatcggtgaactgcacgagctggccgcgctcgtcgtaggcccattggctggacttgccagagcaatcgacgtagcgcgtgagctggccgttggcgttgtactcgagctgcttggtcttgccgctggcgtcggtgatgccgatcggcaggcccatcaggttgtacgcgtattcggtcttgttgcccagcgggtcgatggcctccgtgagccggccgcgcgtgtcgtagtcacgcttccagagcccgccctcggcgtcgctgatcttgatgagcaggtctttcgtgtcccacgcatagtgcacggtggtgccgtctgcgcggatgtgctcgagcaggttcccgttctcgtcgtaggcgtagcggtcgtcgctgccatcggtatggatgtggtgcacgacgttcttggcggcgtcacggtggaaccactcggaacgcttgtcgggatgcacgatgcggtaagtgtagccttggctgtcgtggtagtgccaggtctcttcgccgtgggcatcggtgacatacgtgaggcggatatgctcgtcccacgccagacgggtgtcgaagctgccgtcgtcggcccactcgcgcacggcacgcgcatcggggccttctccttgccactccagattcatccctcgaccggtgcggtcggtgtatcgggtaatcaggtggtgccagtaagcgtaggtccagacctcggcgttttcatcctgggccagcgtcaagtcgccggcttcgtcgtagcggtacaggctcagccgacgctcgggagccgtatcacccatcagccacaggccggtgaggcggccagcctcgtcgacctgggtgcccaggtgcgtgtgcggctggctcaggtcgtcctggtaggtgaccaggtcggagagcaccacgcgatcgccaacgtgatagtcgtagcccagcagcaagcctgcgccgccacgcaactcgatctgcgcgaggaggaagcgcgcgccgtggcgctggtaggtttcacgacgttcgtagccgcggcacaggaccaggcggtgttcgctgacccgcaccagcgtgatgtcctcgatgcggtcgtcgtgcgtaccgccgatcttgggcagcgggtagtcgatgctgcggccatcagccgcgtggtaacgcagaccgtcgccaatcacatcgatgcgcgtggtgtaggggtgatccagcgcgcgccgagttcgccgtggtcgtaggcgtccaaactggagcggtaggcacgcgtccaggtgagcgggaatggtccgggagatggaaatcggtgtgggcgatcgtttcgctgccggtggcaaagctgatgctgccgcccgttccgctcgcagcgcagttcttgcacgggatgggatcctgcgaggcaggcacttccgcggcacatgcttccaagggctgaccgggccggctggattggctgacgctcgtgacgaccggcttgacgttggcgctctgcccgaggcccggacctcgcgtggcaagggcttgttcgagctgcgcgagcgtccaacccaggctctgcgattttcccgcgtcggccagttgccgaacctgcgtggccaattccagagcaaagccgcgaagctccccggccactacgcgcacgcccgcggacgatgccggcgaaattggccgggcgctggcatgcaggctgtcgtcggccgagcgcttgtggaattggaatgcggcatcgtagacgtttgagaatacgttggcgggatcacgccaggactggcggccggcggcggcgctccatgccgcgccttccacgccggctagaatgcccggtctgccggatgccagcgcatccaggccgttcgccaggtccatgatcaagccctggccgagggtggcggcctcgtcgaggaaaccgggcagcgcggctttggcgcgccgcacgaagtcgtcgagttcgcctttgatgctggtgttcagatgggtcgccaaggtggcgagcagcgattcactcaggggctgttcgccacccgcctccaatgcctggccagtgaggtacagcatgggccgcaggctcatgcgcgcggctgcggtatccggcgccggcaaggcccccatcagattgatgccaagaccggcccagtcgcacggttgacgctgcgggctctgcaacagcatgacgatatcgccgaacaggtccgccaacggcaggatgttgcgcagcgtggagacgttgcctgcggcgctgcgtacgccttccagcgtgatcgcgccgtcactgatgccaaccagccagtcgtcaaaagccttgatgttgcgcgcgacgtcacgcggctggatctggttcacgggcacgacggcaacctgtcttgcgcgcgacggaacggcggtgttgatggacatatccataagcgagtactcaaatccgggatggggcatggccttgtggcagcgacgcgccaggcgaaggcactacgccgctgcgaggcatggcgctcgcgcctgtttgcgtcgtcatatcgagccttggccgattcatgcgacaaagcccggcgtggacatggcgcggatcgggtctgccttggcagcgcctggcgcggtataggtgtggccgcccgcggcaccggtcagccagcggcccgcgtctgcggccgaggggacaccgttctgtaccttctcgagcgccgaacccagcagcccggcggcactggtcaacgccttgccggcactggttgatgcggccagttgcccagccactgcgaggcccgtgccgatgaggttgcccgctccttggttcaggttgccgaggacgttggcgacaggctggctggtcactgcctgctgcgcggcgatcaggggccccgacaatgcctgggcacgttgcgcgacgccttgctggggcgcttcgggccacgtcggcccgccaaagtagctgcccatggcgaaggtatcggcggggtctttgccgtagtgcacgcgcgccggaccgggcgcggcgcccgcgacgacgttgtgcccgacgccatcgagcgcacccttgaataccttgcccatcgcatcttcaacttcgtaggtgccaccggcgatgccggcaccgttggcaaagctgctcgcgtagcgattgaacagttcgaggttgccctggccgggcttgggcggctccggaaagctggccgcccggctcttgggccccgtgtagctgaacttggccgcatggcccgtgtagcgcccgctggtctggtgggtgatgccgccggcgttgtccgtggcgctgccgccgccgttgatgaccagctcggtcttggcgttcagcgtgatgcgctcggcggtgtgcgtgatgttgagcttggccagcaggttgatgctgtccttcagcgcgcggatgtcgatgtctcccgccgcggccaccaggcggtaacccatgctctgcacgaacaggcggatgccacggctggcactggcgagcaggcgcttgccgctggtcaggctgatgtgctccgtactgctgagcgcaatgtgctcgccgctggcgatgtgggtcgagcccggcgtgctggtggcgatacccaccgggctggcgacgacgacgtacggctgcgcgaattcgggaaagttgttgctcgccggatcgccggggccgttgccgacgatgccctggtgctgctttttcagcgccttggcgaccgtatcctggtcacccgcctcctgcgcttgaacttcacgggcctgggtgccgaagccctcctgctgctcgccggccacgtccaggcgggcggcggtctccttgaggtccttgtgatgctcgctggcatgcgggcgcggctcggtggtcagcagcaggccggagccggcgcgcaccgcgccgtgctcgtcggtgcgcagctcgaagcccttgccgcgcgccttgccgccgcccgggcgcgggtggaccaggtagcccaggttgagcgcactggcaccctggtcgctgcgcaaggtggtgctgatctcgccattggtgtcgtcgaacagcagttcgttgttgcgtccggccttgtgctccttgctcttgatggtgctgaggatgttgtgcttgggcagctcatacggcggccgctgcagcgccatgtacgttctgccgatgatcagaggctggtcgcaatcgccgtcgatattgcccaccaggacttcctggccgatgcgcgggatggccatgtggccccaggtggcgccggcccagttctgcgaaacacggatccagcaggagctgtgctcgtcggacttgccctgccggtcccaggtgaactggaccttgaccctgccccactcgtcgcagtggatttcctcacccggcgggccgacgacgatggcgacctgcgggccgtcgatgcgcggcttggccatcggctgcgggcgccattccacatcgtcgggaatcagctcggcggtgtagctgtagtgggtgcccagttccgcgtctgcgctttcctcggcctggctggtgtgctgtacgccgcgatgcctgatgcgcaggggccgccagccacggttgaggtcggcgcgcggatggccgatgaggtcgaaggccaggccgggcacgagacgcgcgtcgtcgccttccacttcggcggcgcgggcatcgccgcgcagcccgagcaggcgggtccgggtgaagggccgccccgccgcgtcttccttgtagcggccggggaactggtagacctcgtagtcctggctctggtgatcgagctgcgcgccgtcgtgttgatgctcctggttataggtcgggtgcttgaaggtgtagtcgcgctgggtctgccgcgcggtacgcacgcgctcgctgtagcgcaagcgccgcagcgccggcgtgggctggtcgccgcccggcgtggcgttgtattcgaccgggccgccgtcgatggagccgaagatgtagagattgtctccatggaccaggcggtggctgtcatcggcaaaggcaaaagcgtagtagaagccttcttccgccgccagccgggcgaggaaatgcaagtcgctgtcgcccgcctgcacgcagtactcgcgcggcaggtgcgtctcggtcaccaactgttcgtagtcggtgatctcgtgctccttgagcaccgccgacaggatgtctggcacgctctgccgctggaagatgcgccagtcggcgcacaggccggtgcgcgcaagcttgggctcgaccacggaacggtagcgggtgcggcgaaagccggtgtctccttgttcgaaatcgctgaccaggccgtggacgtatcgcacgggctggtcggcacgccagatggtgagctgcgcgggctggtcgagcaccgccccgaagtcgatcgacggatcggtgctggccaggtcgaccgacagcgtgaacggctggctcagtccttcgtccagctcgaacgaaaccacatcgaactcggtgcccccgccttgaaggtgaagcgcatatcggattgtcgaggcatggtgtgctcctcaatcggtagaaaagtcgccggcgtggatcgccgcggggtccggaattagcgcttgagagtggcgtcgagtgcgcgcagcacctgcccggtgctgctgttcagctgaacgctgaagtaggtgtacgcgccggttagcagcaccagcgcgcaggcccagggtgtccaccacggcagttgcccgccgagccggtaacgccgcgtggcgatgttgcgaacgccatcggtgagcttttccgggacgtcgccacgcaaaccgcgcaacacgtggtgcagccggtcgatgatgtgattgagcgactcatcgcggttattacgcacaccgtatttgccggtgaagcccagacacaggcagaggtacttgaactccagtacatcccggtacttggcgggctccacgagcatgcgggtgagcacggtgaagaatttctcgccgccccacgtttcgttgtggaagtggctgagcagcgagcgcttggcccataccgaatcggagccgccccagggcgtagccatcacggcctcgtcgataaaggcgcacaacgcatagcggaaagccagctgggtggcgctgtcgtagctgtgctggcggatttcctcgtccagcgcgctgatctggtcgcgcacggtttgatatagcttgccgatgtcgtcgcagcgctccagcctgcgcaggcgaatcaccaggcccagcagcggctgcgcgccgtccaccagaggattccagccatggcctcgcaactggaaactcaggtccgggtcgccgttgagctgttcgatccgttcatagccgacggtctggctgagttcgtccgcggcggcctggccgggagccggacgagagcgcgagcgcagcgtgcgcgggtcgtcgatggaaatggtcgtggtcatatcattggctccggatggcccagaactgcatttcaagttcgggaagtcgccggcaacgtggaagccgaagccggatgtctgttgcgtcatgacctgccacgccggatgcgtgcgatcgagttcgaaataaatgaaaccggcgtgatacggcagatagcgaggcgccacgtgcaactgcttgagcggaatgccgggcagctgcaggctgaccagttcaccgaggcgctccatcgaggtgaccttggcttgctggacgaacaactgacgcaggtcgtccccggacatccgggcgcgcacggcgagcacgaattccgcgctttcgatcagcgtgcgatcgtgcacctcggcggtcagcgtgccgtagcgctgctcgatgatcggcagcgacaccgcgcggggctggagcacggtgctcagggtccgccgcagggtatccatgagcatgcggaaggacacgcgcggatcgtcgtgctgataggccgggtactcctgcggcaaacggccttcgtcggtgaaggtgaccagttcgccgcaggcctggatgaaggccacgtagagatcctcgggatgcacatgccgcttgcgcgacagatagccgaaccagggctgcaggcggttgatgacttgcaacaggttgaagtctgtgatgtcggccacgcccgactgcccggcagagccgatgcgctcggcgatgctcttggctcgctcgcgcatcagcccggccacctcgccgacgaagcgatgcagcggcgcgatggcgttcacggacaggctggtggggtagaacccgctgtcgtccagcaccaggctgccgtccgggcggcggtcgagaatgcggcacatggcgatgcctgtgaaggcgctgcggtcctgctgctccagagcgaactgaaggttgggaaccacgaggtccaccggctggtgatcgccttcgaggctgtgcgtgtcgcgcacggcctccgtgcgggccacgtagcgtgcgttgacgtaggtgtccggccagcggacttcgaggccgctgtcctgcttgagcggcagcgtaaggtagaccgtctgattggccacgctggcatcggtgatggccagggctccggcgcgggctgctcgccgggaatgtcgatgacggtgccgtctggcatcacgccgcgcgcccgcacgatggctaccttgccgaaggccaggtactcgtggttgagttccagctcgctgaagccgtagagatgatccctgacgctgtccagtcgctggttggcgtggtactcggcggcacgggcctgctgctggaagtgctggggttggacgaacagtccttcaccccagagaacggcgttgcgtgaagtcatggcgttacctggattcgggataggttggaagcggccgacaggttcggagccgaaggcaacggccccgccggcagcggcgggacggccgtcgccgccggcagcttcgacgccagctgcttggttggtttttgatgggtgcggacggcacggagcaggcggcggatgcaggggtggcgggtagcgcaacaggtaatgcggcaggtggtacgggccgcccctcgcgcgtcaggctcacgctcgtttcgctcaacttgaccagcaaggaatacttacgacccttgggctcgatcggcattacctgcttccaggccaccgcgttcgcgtcgtggaagtccgcaatggcggcgacgaagcgcgtgccgtcgcggatctcgccgaaaggcaccaccttgaactgtccaggcaacaacaggtagtcgtcggccgccaggtaggtgctgcccagggtcttcttcaagtccttgcgcagttgatccgggtcggcattgagcagcatggagtcgtccttgagctgcacgatcttgaaggcgatcggggttccaggtgccttggccggtcgcgaccgggcagtcgacggcgcaaagctatgacggcggccattggcgtcgtactgacccagctccaggccctgctggcccaccgcccctgtgttcggcaacggaggcacattcggcagcggcggcacgagcacctgctcgctcgactgccccgctttctggcgcgcggatgaagcgccgacgccggccgcaggcctcgcgacaaaggcggaagcatcggcgccggtgcgcagctgctcgagcagcagttgcaggttttcgagaagctccggcttgttggcgctgacgaagcgcacggcataggggccgtcttccgcgtcctgctcgtcggcaacgttgaacccggggacctgatgctgcccattgggattaacgtcgtggtctgcgtacaggctcaggccgatctgggtcggctggtcatcgtccacgcccacctgaatggacgggtccatcagaacctgccccgtcttcttgaagacatttccgatagcgctgcatcccgtgagcatcagcagtggcatcagcgcccagacgagccgcttcatcgcggctcctgacgcagggctcggtcataggcctgttcgaagacttcccagaacagtttctcgaagccttgctggcgagacgacgccagctcgttgtagtagtggatgtacatctgccagttccagtccgctgcctcggtttgctggacctgggccgcccgatagcgctggaagcgctgctgcagttgctccggggtgaaggcacgtaacagggcctggaggctggcctcgatagcctcgatcagcgcggtctggtgccgttgaacctgggcgaggctttcctccacggcggcggacggcgacaggtgcacgacgctacgctcgctggagaacaacgcgcgcacagtctccgggtagcccagccccaggcgcaggggttgtcctcgatgggctggagcgtacgggccagcggcgccagattgcgcggcttgccgtcctgcgtgtgctgcaaggcagtgatgccgtgaatgaccgcgctcaacgtcctgccgatctcctgcaagagcgcgtgtcccatctgcggatcgaccacgccgaccgaggccccagcccctccaccaagggctggatcagggcattggcgtcgccggtcgagacggctcgcgagtaggactgcggcatcgtggattctccagataaggtcttgggtgagccggacacggcttcgaatcgggtacgggcgtggttggcctgggtctggccgggactgaggccgtagttcgtagggtccagcggggcaacaccgagtaccggctcacaccgctgttgctcggcatccagggcggccagcggatcgcgttcctctgcgggccggcgctccctcgcaagatcatcgaaggcccggaaatcgggctggcgcggcctcgcatccagcgatctgtcggtctcggtcgtgggggcaggccagcgcccggctcgttgagcaactcgccgaccgaacgctggagcagcggctggctgttggtcagatgcgcttcggatatctgcagatggacggtgacctggtaggcgccgatatgcagcacgtcgccgtcgcgcagacgcgcggccgtgcctcgcctcaatggcgtctcggcgtcgttgacgcgggtggcgccactctggtcgcgcacgcagtagctgttgtcgatccaggtgatctcgcagtgaatcgcctgcacctggccttggccgtcatcgagcagccagtcggcgccacgactgccgatggtgccgccagcgtggccgaagttatgccgtgcagtgctgccggcacgcagggcatgggtattggcaacgaggagttcgaggcgctgcatgcctgccggcgcctggcttgttggtggaatgggcgtgttcatagtcgcaccttgatacgcacggggttcgagtggcgtcatcaccgttgacgaaagtggtccagccaagatgcgagccacgctcccggctcaggttgaaggactcgacttccgccgggcgaagccgcagttccaggtcgaaggccatcgggtcacgcagcaggaattccatgagcttgcgcaggcgtgcgaagtcttctccgctgggcaggaagtggcggaagcgctcctggtcgagatcggagatgacgacggtgaacttgttgtggcaggcacgtacccgcttgccgatcacgaagctgtcgccgacctcgccattacgcttgcccaacgacaggcgctgcccggacgggatgtcaacgtagcgaatctcgaactcgcgcacctgaacggatttcagggcgaaacaatcggccacgatgcccgcaaccatcgacgcggagcgactgcggttgatgatggagccggcgaaactgagcagacggctccagggcaacggtgtcgcgccgcgcaagtcaccgttgcccaggccaacgagggcaaatacatagcgggagaagccatcgctggcttcgctgcggaagcggatgtggtagcggtacttgcgccatgcccggtgcagcagcgtgagcaggcggtggtgaaagaagtcgaggaaggccggacgaatgccggtgccctgcccatgctcataggccagacggtccaggtagtagcccggcagcggcgagtcagggccgtgcagcccgaagaagttggcctgcacctggtagtcgctggcggagctgtcgggcatacgcgcggcgaagctgatgtccgatgccggaaacgccagtgccgccgagctgcccaggcggatgcgccaatgggcatccccgagcggatcgctcgcttccaggtcgtcgccgtgcagcgcatgcaactgctccagcaagcggaagaaatcgtaggccttcgcgctggcgagcaccgcatcggcgacggctagatcagggttgcttgccgatctgcaatggccattgatagtgctcgttgttgctgatgttgatgacttccagcacatggaaggagttgatgctggcgtagagcgcaaggaaatggctcagcacgctgccgaacaaataaaggtccccttcgcagaggaaggcatcctgatccagatgcagcaccgtcttcaggccacggatgggcaggcccttcatgagccagtccatcggtttggtctcggcctcgccgatgccggccaggcgcttgctgctggcccgtgcatgctggatgtcatgcaacgcggcgaagtcgtaggcacgcagaaccgccttgagtggctcggccgaaagcagagacaggtagttcagcgacaggttggaaatgaggctccactgaagatcgccgtccagcaccgggcgataggatggcgtcggacgcgtgatgttgcgacagcggctgtaggacggcgccctctccgatccttcgcagatgtcgcccacgtccagtgccagcggaaggtcgcgattggtgcaggtgagcgacagcgagaccgtttcggtctggtccacatactcgctttcgtcggcgcgcacgaaggagacagcgtggtcgagaccgctgccgtcaagcgcgttgccgatgtgggttcggtagtagatcgcggtacggccttcggcatgctccacttcgtgcgccatcgactcgaaggggcggaaggtccgcagccggtcgccacgtcgcccatcggcgcggcgacgcagcccgcgaacttcgtcgatgctgaagatctcgtaggcatgcggccgctgccccgtggggtagaccggctgttgcgcgaccttgccgtcgatcctgagcggctcggcgtcatgggcgaacaggttgaccgccggggtgcagtacaaggcaaggtcgccatcgcgcaggcgaatgcccggcggcatcggtcggttgaagtggaactcgatccgtaccgtctcctggctggtggacggccagaacggcgccaagccgctcaaccggaagcaatggaaacgctggggaaaaacgaagtattcctgcaatatccggtagccgtcgaacgcatttttggatacggcagcagggcttcatcctccgcaaaaccgggaaactccacctgtcggttgggcagcgagaatgccttgccgtcaaggtccaccctgaccttgtcaaggtactgggccaaccagagatagagggtctgcgcggtggtgtcgtcgccactgagctggaaatccagccggtcgcagtccatgaggctgggcgggttatcggtcaggaacgacagctcgaccgtcaggatcgacttttcacgcgagtgggcgtcgctcacccgggtcatcttgagcggcaacaggtgaacgtccgcgcaggtgcgaaagcgacactggacgccatcgaccgggcgcgacaacacgagggttcccttcggaacggtttgccgctgcgtgatggcggtttcgaccggctcgaagcagacgatggtcgagcttggtagcggccgaaggtagttcggccacagcagctgcagcatcgagtgagtcagctcgggcagatcgtcttcgatcttgagccgcagcttggcggtcaggaagccgaagccttcgagcaggcgctcgacatcagggtcactgctctccccgccaagaaaacgggagagttgcggattgtcacgggaaaactcgcggccgaagcgacgtaagtagtcgagctcttctcggaacttgcggcgtaatgtcatggcaacgactttccattgcggattgcgcggcgggtcaggtaaaccgcgcggtcctgttgtgatgctgaagcaccaggtcgagctcgatgctttcgtatgcgttgcgaaccggcaccaggcagtgcagcctgaaatgcagatccatcgggcgcacggcatccgtgagtggctgcacgcgagtcaccttgacccgcggctcgaactcgttgaccacggcctggatgtgctcgctcaaacggtgccgaagatctgtgctgccgaccgcgacatcgttgaaatcgggcagacccagttcaggactgctggacgaacagccctgccgggcattgagcacccactcgatatgccgcttgatggcctggatgcgttcggcggccagatcctggctcgttcgtagacgtcgcaacggaagctcgggatcgagccgctcgaacaaacttccctgtccgagcgttctcggcatggtctaggctctcgtcattccttgtcgagcctgccgaccagggacagttcgaagttggcacccatgtacttgaagtgcggacgcaccgcgagcgacacctgataccagcccggatcgccggccacatcctgcacgatcacgcgggccgcccgcagcggacggcggctgcgcacgtcggccgaggggctttcctggtcggcgatgtattgcttgagccagttgttcagctcccgctcgaggtcctggcgctctttccagctaccgatctgctcgcgctgcagcaccttcaggtaatgcgccagccggttgacgatgaacatgtacggcagttgcgtgccgagcttgtagttcgtctgcgcggcctggccctcctccgtcttcgggaaaatcttgggcttttgcaccgagttggcggagaagaaagcggcgttgtcgctgtccttgcgcatggtcagcgggataaatccggcttcggcgagttcgaactcgcggcggtccgacaccaggacttcagtggggatcttggcctgcaactggccgagggactcgtacaggtgaaccggcagatcatccaccgccccgccggacagcgggccgatgatgttcggacaccagcggtatttggcaaagctgtcggtgatgcggttggcgagcaggaacgaggtattgccccacaggtagttggcgtggttaccgtcgatgccttcgcggtagacgaaggtgcgcgtcgggttgtccagcgggtcgtagggctggcgcagcaggaagcgcggcatggtcaggcccagatagcgcgcatcctcggattcgcgcaggctgcgccatttggcgaaacgcgggccttcgaagatgtcgccgatttccttcaggttgggcagttcctggaagctctccacgttcaggaactcgggaccggcggcacccaggaacggcgcgtgggccatggcgccgaccgcggccacgtagcccagcagcttgatgtccggcgccgaagggccgaaggtgtagctgctgaccatgcagcccaccggctcgccgccgaactggccataacccgccgtgtacgcatgcttgtagaggccgctacgggtgatatcgccggcaccctcgaagtcttccagcaactcggccttgccgacgtgcatgaagccgatcctgatgttctcgcgtgtatcggtgttgtcggccaggagcttgagctgacgccagtgggactccaggttctggaacgacggatcgtggagaatctcgtccatctgcgcggtgagttgctcgtcgagccgggcaatcatgccgtccaccagcagcttgctgacgggctgctcgcgatcgtccgtcttgagcatttcggcaatgaaggcggcaacgccgcgttcggcgacggcatagccctcgtgactgggctcgatgcgcgtctgcgccatgatctgttcgagcagacccgggattgggccgtttcagcccgggcaacaacagcgctttcggttttcatgttcgtttccttgaagccgcggagatattggaaggtgtgatgtgccgcgggaggcgcgtcagtcggacgagccctcgagcgcctggctcagctcctgcgcgagcttgctccgcgcagcctcatccccgagcagggcctgcaactgcttgcggaaggccggcacgttacccatgggccccttgagggctaccagcgcctcgcgcaattccaggagcttgcgcaactcgggcacctgccgggcgacggcatcgggactgaaatccttgatgtgcctgaactgaaggtcgacggtcagcgcgtcgtcggcaccggcatttccgaggcgcaacggaacggtggttttcaacgccacgcccgcctcgctgagcacatcgttgaagttgtccttgtccacacgcaccaccggcctgtcttcgagagcggtctcttcttcgcgccccttgaaatcgccaatcaccagcatattcaaaggcagctcgatctccgcctgctgattacctgtagccggaacgtatttgatattgattcgttccttcggggctaccgatgccgtgctcttcgccataaatgctccttatccttatttcttgaggatgctggaaattcgctctcagccgtaaaccgcagcatgaccgaactggttcggaatctgcctgggaaatcatccccaatattccttggccatcggaaaccatggctctcagaagcgcttaccagacatattcagccatacgcggcccgcctgaataattgacctcgctccgccgcatcgtcaataagacatgtctgaaatttcactcaaaataaccgcgaaatatcacccaaaaacgagacaagaaaaacatgacattcagcaataattttccacgcacaaaacaataaatatctcatttactaatcggcaatattatgtttccttaatgggccaaccattccctgcaccactgatatagctgcgtgcaacgactcgtttccaaccatccttgatgggctgtgcttcatgatccgaattgaactctcggcagtcttcgaccgcttgaaccctccctctcgccaagccctggaagaggcagcgagcctgtgcatcagccagcaaggcgccgaagtcacggtgccgcacgtgctgctcaagctggtggacctgccgttggggacgtccggctgctattgcggcaggccgggctggatccggacgccgtgcgccaggcgctgtcggccaacttcccgaaccaggaatccacaggagggcaataccccgcgttctcgccgttgctggtcgagctgttgcaggaagcctggctgttgggttcgctggaatggaaccaggacgccatccgcggcggcagcctcttcctggccgcgctgctcaaccctggccgctatctgccactgtccgccgtgcgtctgttcgaccgcgtcaaccgggaagcctggcgcaaggacttcctgtcgttggtcgcgacctcggcggaaacgccccaagtggcggagcgcgtcccgtcgcccaccatcgcggcaaccgattcggcgctggccaggtacggccatgatttcaccgcccaggcgcgtgaaggacggctggacccggtgctgtgccgcgatggagaaatcgatctgatgatcgacatcctgtcgcgccgccgcaagaacaacccgatcgtcgtaggggacgccggcgttggcaaaagcgcggtcatagaaggcctggcgctgcgcatcgtccaggggcacgtacccgagccgctgcgctccgtgacgctgtggggattggatctgggcgcactacaggccggcgcgtcggtcaagggcgaattcgagaaacggctgaaagcggtcatcgacgaagtgaagaccgccgccacgccgatcatcctgttcatcgacgaagcgcacacgctgatcggcgcgggcaatgccgctggcggcagcgacggcgccaacctgctcaaaccggcgctggcccgggagaactccgcacgatcgcggccaccacctggtcggaatacaagaagttcttcgagaaggacgcggccctcagccggcgcttccagctggtcaagctcgacgagccgagccccgagacggctgtccatatcctgcgggggctacggaacacttacgagcgcgctcacggggtctacatctccgacgaggccctacaggccgctgccgggctttcggcgcgctacttgtcgggccggcagttgcccgacaaggccatcgacgtgcttgacacggcttgcgcgcgggtggcgacggcacttgccgaatcacccaggcgattgcgggcgctggagcacgaactgttgcagatcgacgcggagtcagcgctgctgcaacgagatcggcgtgccggcctgcacgctgacgcgcaacggctcgaggtactggacaacgcgcgccgcgaggttcagggcaagatggatgcgttgcaaaccgcatggtcatgccaaaagccgcttgtcgatgaaatccggacgctacggtcgtcgctggcggccgacggcgccccggacgatgacgaacgctccaaacaactatcgaccaaggtgatggagctggcggcgctgcaacgcccaagcgcactgctgcatgcggaggtaggccgcgagcaggtcgcgcaggtcatcgccgactggaccggcattccggcgacaaccatcagcagcgaccagatggcgcgcctcggggcttgccggaaatgctgcgggaacgggtcaaggggcaggacgccgccatcgagcacattcaccagcatctgctgaccgcgatggcggacctgcggcgtcccggcacgccgctcggcgccttcctgctggtaggccccagcggcgtgggcaagacggaaaccgccctggccctggccgattcgctgttcggcggcaagcagttcctgacgacgatcaacatgtccgagtttcaggagaagcacaccgtgtcgcgcctgctcggcgcgccgccgggatacgtcggctatggggaaggcggcgtgctgaccgaggcgatccgcaaacagccctactcggtggtcctgctcgatgaggtcgagaaggcgcacccggacgtgctgaacatcttctatcaggccttcgacaaaggtgagcttgccgacggcgagggtcgattgatcgactgcaagaatgtgttgttcttcctgacctcgaacctgggattcgaccaacaggaaaacgagctgaccgaccaggacgaggccgctcttcgcgaacgcctctcgcaattcttcaagccggcactgctggcgagaatgcaggtcgtgccctatcgctatctggacgatcgcgtgctcgggaatatcgtggaaagccgcttgcaaaggctgatgacgcagttcacccagcgctatgacgccgtcttgtcggtgtccgcgagcgccagcgaggaactgcgccggcgctgcacccgccaccagaacggtgcacgcatgctggatgcgagcatcgacggcgagttgttgccaccgctgtcgttgtccgtcctgcagcgactggccgagggcacggccttccggcgtgccgagctgtcgtggagcggcaacgctttcgaggctgtcgtggaatgacgatgccgcggcaactggatccgatcgaggtcgcgcgcatcgcgcgcgacatgacctgggcgactcatcccgacgggctggcgacggtgctcctgcaagcagctgtggatagcggctcgttacgcctggggatgtgctatcgcctggatcagacgagtgactgcctgcggccgctgtcctgcgtgccggaaaaagcgtctgctctgccggagctggatatgggcgagttggacaatccgctggtctacggcctggtcagcggtcatccctgcaaggtcgagcacatcgccagcgtggtcggcgtgggcagctctttcgagcggctgcgcgagcgtttcatgcccggggacggcgcctggatcctgccgctgcgcgatgccaatcagcatgccttcgcggtcctggcgctgctgggcaatccttcggcactgcacgcattgcgcgagtccgcgctgtggcaggcgctgctgcaaatccatgagcgcctgttctccggacttcagcagaacctgggcgacgcggcgcgggcccgttccgccgacgccatgcgcgcgcaggtgcatacccgcacacgcgagcgagcagccaggctattggcggcggagttcgtcggcgtgagcccggcggtccgcgaactgcgcagcgacatgctgagcatgacggactcgaacctggccattctgatcaccggagaaacaggcgcgggcaaggatcacgcggcctggctcattcaccagacgggaagccgccaaggcaagttcgtgccggtgaactgcgcggccatccccaaggatctgatcgaggcggagctgttcggcaacgagcgaggtgccttcaccggcgccagccaggcacgcgcggggctcgtggcggaggccgacggcggcacgctgttcctcgatgagatcggcgacatgccgctggaattgcagggacggctgctgcgcgtgctgaacgagaaaaagtaccgtccggtgggcgcgacgcaggagcgtcattccgatttccgcctgatatgcgccacccaccagccgttgcttcaacgcatcgccgaagggagctttcgggaggatctgtactttcgcatccgccagcaatgcctgcacgtgcctgcgttgcgcgagcgtccggaggatattcccgttctggccgagcacgtgctgctgcaatacaaccgcgagcgacagactcacatcccgggcatcagcgccgaggcgttgcgcatgctgcagatgcacccgctacccggcaatgtccgggaactgcgcaaccttgtactggtggcagccgagcgcaccgagcgcggccaggacatcgcgccacaggcattgcgcgagctgcgctccctgctccacgaactccccctccccaccccgtcgacgatgccgctgcacgatctctgggagaccaacgacctgcccggtgcgctggcggctttcgaatgccacctgataagcgaacgcctgcgtcaggcaaacggttcgcgcgcgcgcgccgcgcaaagcctgggcatccccaaacgcacgctggcacgaagatgccagcgctggaacatttttcaggaggactcagcacaatgagatcactgagcatcgccatggtttgcgcagcgctcgtggccggatgtgacgccggcaaaccggggccgccaccggtccgtccacagcggccccggcagccatgaaaacctgtaccgccattgtgtctgcggttgaacggctggcctgcttcgatgcccttgcgggaacgccaccagcaccggttgcggcgacgcctgccacgcaacacaacgaggcaccggcaagagccgacagccagaagccggcgacaacgccagcgatcgtcgagctggtccgcctcaacgaggcgaaacgcgctgcgggcgagacgggattccggctgtcgcgcactgaggaggctgtaccggggcggtggagcgtggtgatgtccgctccggcgttgggcggcgctaccgcgccgccgatcctggcgatcagttgcctgtcgaacatctcgcgtctgcagttgctggaaaaccagccgatcacgcccaaccggatgaacatccggttactgctggacgggcagcccatctcggcctcggtgccgtggcaggtactggaggacggcacggtcgtggacgcggggcggggcctgattgccatcgaacaactgcgatacctggtcaaggctggcggccgcctgcaggtcgagagcgactatgcgccgttctccgggctgctgttcgatgcaaccaacctgcataacctgatgaaacaacagcgtgaggcctgtcactggtgatcaacctgcctccctggatctggacgcattgctcagcccgcttgacgccaaacagccggccggcgtattcgatgaggaagacgaaacgtatcagggtatcgagcatgaaatggtcaagctcggcagcctgcaggaaggcagtatcgactggtcttatgtcgatgaggcctcgcgtcagtacctgagcagccagtgcaagcacttccgcgtggccgggcatctggtcacggcccgccttcgcccccgcacctggccccactggaccgaggcgacgctggtgctggccggcatggtcgagcgctactgggaaaacggccagcccaaacccgggccgcgtggcctgctgaccaaacgcaagctggtcgccttgctggtggagcgactgagccaggcattggagacgctggatcagaagacctacaaccccgggctgcaggatcgggcgcaacaggccttcgaccgattgcaggcagaagcaatcgcggcgcagttggatgtatcgatgctgtcccggctggaagcgcagatgcaccggcatgtcgaaagcaccctgttcccggagccggtggttctcaagccgagtgacggtcagcaaggtgggcgcgcgctgagcgacgcattcttccagccgagcgagataccgaggtccggcgatgaacgcgaggggcgccggacgctgttggcgatggcggagttcatcaacgaacaggacatctacgatcccaccggctaccagttgcggcgcttcgcgctatgggcacacctgcgggccgcaccgcccgcgaagcgcgaccagttcacggaactgatgtgcgtgccggtcgataccgaagaggcctatctcgaggcgatctcgaccaattcggtcagcccggtggtgttgcggcgcgtggaaaagagcgtgaccagttctccctactggttgcgcggcagcttcttcgcggcggccatggcgacccgtctggaaatgccggccgtggctgaagccatccgtcacgcagccgaacgcttcctgttgcgcattcccggcttgagcgaccttcgctttgccgacggccggcccttcgtcgacagcgacaccttgggttggatcggcagcgccgaagcgcggcctgccgatgccggcgcaccgcaagagttcgtggatttacgcgaggaactggccagccggttggacaccgaaggtgttgaacccgtgctgcgccgactgcaggcgcaccaggcttcgtctggtggcccacgtcatcgttgccacgcaaccgtgatcgcggcggacctgctgaagtcacggggtttggattggctggccgaagaactctatgccaatgccagccggttgatgaagggcgtcacggtggatcaatgggaacctgaactgttccaacacctcgccaaacatgtcccggcgcctcaggaaaacgaacatggacgaagccagtcgcaaggagagagaaaatgaaatactggtcgttgctcaaacgatatgccgccccctggcgcgttgggtcaagggcggcatgccactgctgctggtactggggctgctattcctgttgttagccatctggtggctggggccgcagtgggcctggcgtgatcggcatcctctggcgagcctgggcgcccgggtcgggctgacctttgccctgctgatgattcccgtggtggcctgggccctggtcctgcgggccaggaaccgccggctggaagccgagcgtcagcaagccagtgccgtcaaggaagaccccgtgcttgtccatatccgcgcccaggagaagtccctggacgccaacctgacggtgttgcgctcccacctgcgaggccgtcagggcctgtaccagttgccgtggtatctcgtgctcgggcaagaggacgccggcaagaccagcttcatcaaccgcagcggccagaacttctcgctcacgggcgagatcaaggctggcggtcatggcacgttcatcgaccccgacctgatctaccggaccgattggtggatgggcgaccaggctgtgctgatcgacccgcccggagagttgatcagccagtttcccgcagaggaacatgccccacgggggcatcgacgaccgacactgaagaagcgccggcgcccgagcagcttggagagccgcccgagactcgggcccgcctctggcagcatctgatcgactggctgggcaagaaccgctcgcgacggccgctcaacggcgtggtgctgatcgtcgatctgccctcgctgctgggccagaacgccagtgagcgcaaggcactggccgtcctcttgcgcacgcgcctggcggaactgagccggcatctcggaacgcgtccgccgctgtatgtcgtcctcagcaagttcgacctgctggagggtttcgagcagttcttcgccaggctgccgaaggcggaacgggaggacattttcgggttcaccttcacgctggattcagcgcgacagtatgacgcctggcagacagagctcagccagcgctacaccgacttcatcgatggcctgaacaatcaggtcttcgatgtgttgaacgatgcgaagtcgctaccgatacgcgaagcgctgttctcctttgtcgggcaaatagccggcttgcgcaccgtgctgttcaatttcctcgacgacgtgctgggcagcgatcgctacggcacccccgccttgccgcgaggcgtgtatttctcttcggttcatcagcaggggttgctgcacaacgctttcgtcgacaatgcctcgcagacttacggtgtgcgaacgctggtacccatggcacagccggcgggacgctccatggtgtactttgcccaacaggtattccagcgggtcatttatccggaagccggcctggccggtgacaacctgaaggtgctggccgacaagaaacggaatctggccgtgggcttcggcgtcgcggcgctaggcagcgcggtcgtgatcggcggctggtatcactactacaccgtgaaccgcgcactggtggcgagcgtgctggagaaaagccgaacgttcgccagcaatgcgatcgacggcggtcaggacccgaccggacgaaatctgctgctgccgctggaccagcttcgtgatgcggtggccgtctacggcgactaccgggatgcatggccgctggtatccggcatgggtttgtaccagggacgcaaaatcggcccgaaggtggacgaagcctatctgcgcttgctttcgacacgcttcctgccgcaattggccggcggagtcatgacgcaactgaacgccgcagcggatggttcggatgcgcagctcagcgcccttcgggtgtatcgcatgatcgaggaccgggccaaccgccgcgctcccttcgtggaagactggatgagaaaggagtggcaggcggcatttcctggcgaggcgccggtgcaacgcgccttgtcgagccatctcgattacgcgctgaagtatgccgatgtgtcgctcccgcagtatgccgcccgggtatccgatgtgcagcggcaattgcggcagattccctcgccgcagcgcatttacatggcgatgcgcagccaggcaggcgacgtcctgcggacaccaatggatctgcgcaacgagatcggtccggcctatgacatcgtctaccaatccacaaccgctgcagccgagggtggcgaacaccagggtacgcgcatcgacgcgctgctgaccgccaagggctatcggaactacttcgagccgcgcaatcaggatgtcgccgcgctggccgtcattgaccaatgggtgctgggcgaacggcggaacgtcgactattcggaagcagacaagcaagccctcgtcgcgcgtgtccgcgcgctgtacagccgtgactacatcgagaattggcgccgcgggttaaaccagctcgaggtcgccaatttcgacgacattggcaccgctgccaacgtgctcggcgccgtgaacagcccggcggcgccctgcgcaggcttctggaaaccgtgcgcgacaacaccgatctgacgtccaaggcggcgtcggacgcggcgcggaccgaaggcactgccaccgcggcaaagagcggccccgacggcgaagcccaggatatcgccaagattgctcaggcattcacaccgctgacagcattgcttgaagccaagggcgagaagccttcctatctggacgagacgatgcaggccatcggcagcgtccaggatatgttggtgaaggtacaggacagcccggaccggggaaagcggcgctggcggtgatgctggatcgctttgcgctgcgcggcaccgatccgctgggcaatctgcatcgggtggctaccggcctgccggagcccctcaatcgccaggtaaagaaactggctgacgaatcctccgacgtgctgctgatcgaggcgctgcgcgagctcgaaaagcgctggaatgccgaggtcttcagcttctatagccagcgcctggccaacttctatcccttcaatccgaacagtcgcaccgatgcctccgtcgaggacttcaccgccttcttcggcccacaaggcaagttgcaggacttcaaggacaagtacctgaagctgttcctggacgacaacctggaagcactctattcagagcgtcgaggggctacctgatgcgcaccgatgtgccaaagcagctggaagcagccgatcggatccgcgatgccttcttcaacagccgcggtgcgatggccgtgcatttcaccctcgagccgcttggcctggcacccactcgacggagcagcgtgctgaatatccaaggacaacttatcacctataaccacgggcccagcgagactgtcggcgtcatctggcccaacacgcttggcggtagcccggaaagccgcatgacgctcgtcaacggcgatggcaacagcagcagcctggtctacaagggctcatggtcgctgttccgcctgctgagtcaggcacgactcaatggcgcaacggctaccaccgtcgacctcagctttacggccagcgatggcggcatgcgttaccgaatcaccgcggacaagagcaataacccgttcacccagcgcttgttccacggtttcgcgctgccaggcacgttgctgcaatgacagccgggtcattcctgacccggccaggtcaagaatgacccagatttttcctctttgatttcaatagcttgccagctgacgagtcaatcttgacctatctgaaaggagtcgctggcttgcttagccgactcgaagcgcgccggcacaagccaaatcgaaacataaaccattgatttacatatttattttatgaaacacggcagcatggcacggcgattgcgatgtaggtgttgctatcactgatggcgcatcgggccatgggggcccgccataacaaaacggagtaaagcaatgcctacacccgcctatatcagcatccagggcaagacccaaggcaacatcaccaaaggcgccttcaccgccgattccgtcggcaatgtctaccaggaaggccacgaagaccagatcctggttcaggaaatcgagcacctgatcgctaccccgaccgacccgcagagcggccagccctcgggccagcgggtgcacaagccgttcatcttcacctcgccgctgaacaaggccacgccgctgctgtaccaggctctggcctccggtgaaatgctcccgaagtggaagtgaagtggtaccgcacctcgaccgaaggcaagcaggagcacttcttcaccaccaagctcgaagacgccaccatcgtcaacatcaacacggtgctgccgcatgcgcaggatccggacaaggctgcgtacacgcaactggtcaaggtggccatggcttaccgcaagatcacctggactcaccccatcgccggcaccgaggcatcggacgactggcgcaaaccgcaggaaggctaaatctggctaaaggcaaggctggcgcacaccagccttgcttgacgtacgggcgggctacccatccgatgccgcgactaacttgtagggagtgggtatgaaaggcactcgcctgtgcggcgcgatcgaagtgacgccccagaaccaccacgaagttggtttgtgtcactgctccacgtgccgacgttgggctggcgggcccatgttctcggttctctgcggctcgaacgagcagttcacggtcgatgttcaacctgacgcgccattcgcatcatcatgctcagggcgaagtgccctatcaggatctcaagccgtttgccgatgcgccgatgatgatcggcggctacctgacgacgatcgtcgtcgcgatgattccgccgctttcgcaccggctgatgcccccaaggtacttgcatgggatcgcacccatgcgacggaaccggaacgacgcctcgcggccgacgccaatgcgcgcagcggtatgacggggttcgtggccgcgacgtgatacaagcctcgcgcgggcacgacgcgaaacgcgtcgctgcgtttttcacgggtgacgtgacacgttggactcctcgtcgaatcgcgatacggctccgtggcggcgctggctgcggcccgcagcagcgtggcggccggtacgctgaatgtgccggcgtcgaaatcgatgccggtacattctgtcgttcaatgtttgcgggaagcgaagcgtgttgtacgcgggaacgtgcggtcgtccatcattccggcaatcacgccttgcccataccgcccggcaacgcggcgcgcatcaatgcagccacttcatcacgatcgtcgcgaacacgaccatcgcggcgcagcggatattgccagcaccgttttcggtcccggccacgctcaccggcattccttcgcggggtcgcttcatgcaacggaaaagaacacgcttacgctcttgactccgagaggccgtaccttgaaatgtgtcttcatcggcatcgcggggaacgagatttttcctgcgctctaacgtgagcgaaatttccaggagatcacttgcgagtacttgcgcctgtttcgcttgctccgcgtggcgcttgaggtcttccaacggcgaacccaagtgatcctccgttccgcccatgaaaatcaaaaccgcagcgttggcgtgggcgcgggcgcgcgcggcgtggaactgagctttccggacacgtgagccgatcaggtctacgtgagcgcgagtgcccggaaaatgcgcggtcggcagcctcgcgtgccgaacttcgagactttcgagttcggacacactcgcttccgctctgacggcagaaatggtagcggcgaggaccacatcggccccgctcggatcctcgacaagatcgctcgacgattgaaagccgattggcttgcgattcgccgcaggaatgcaactcgaaacccgagcacgaatgcgtcccaacgcaacgcgaattcggtcgagcgacatggatatggacatggcagggcataagcctatgcatgaaccggaccggcactcagtggccaacgaccgtattcgggatgatgcgtgacgacggacgatggcatggcaattcaactcagtgcatcggttgccgatgatgccgccggctccgcgatccaattcgaccggtggatcaggaactgttcccttgcccggccagcgatccaccgaggctctcgtccccgcccactccataaggcgccagactccggatcacgatactttacagtggccgggccgcgacgcttgccgcgacgcagcttgagcttgcgttcagagaacaggtcctctggcatcaggtcgaattcctcgatcaatttttgtatttccttaaccgcactcgccaattcctgagtgcgggcaagctcagcctgcttttgaagttcctgaatctgctctttcaaatcacggtagctttgcatatcgtattctcgaagagaagagcgccaagcactcaccttggttctcggatgttgcgatcattaaatatagggatgcgaattatatgaatcagacgcaccacacccgtatgaaatcaaaagcgcgatcgagagtgggatcgcgaaccgcctgcgctgagatctcgcgagtcgccgaacacaggcagggccggcgacagattaccggctccgtgccctggtgttcgatccccgttggggacgacgaccgcattgggtgattcgggcagaggcagtggctggcgcgcttgcgcggcgcgcctcgttcacgatcgactccacttctgccagagcggaccggtcatccgggacaccatcgacgttcagcgcgattcattgatttcccttcagcttcagccagaccttgttacgcagttgaatcgctgcaggtgaacacatcttgtaaggcttgagtcgatccttatactgctccggcgtcttgatcgcaggattgtcatgcagcgcaggatcaatgtagcgctccgatccgacaatctcgttgctgtaccgtagcgcgttcgtcaccagcgcgatgttctcgggtcgcatcatccagtcgatgaacttgtaggccgagtcgacatttcgcgcttttgccggaacaagcaggctgtccatgaacagtcggacgccctctttcggatatacgaaccggatagtcggcaagcgatcctgtgctcgcgcagccgcaccgttccagacgtgctgcacgatgatttgcctggacgcgagacggtcgaccgttccgtcgttgctataggtcttcacgaatggtttctgcttctgcagtacgtcgaggacgcgtttcgcatcgtcggggcgctcggtgcattcatcctgtcccagataccagctcgctgccatgtacagttcctcctcgacgtccagatcgccgacctcgccgcgaagtgccacgggggctcgaagaacgacttccagctatcgtcgaggcgtccacccggcacacgcgcgctgtcgtaagcaaacccggtcaggacgaccgtgaagggcatcgcgtagtcccgctggggatcgaacgacggatgacggtactcaggcttgatgtttgcgacattcggcaacttgcgcttgtcgagcttgagcagaaggccggacttcacgagcaccggaacgtagtagtctccggcaaccacaacgtcgtacccccgcctcctgcctgcagtttctgggtcagcgctgcatcgctcgcataggtgtcgagtgtcgtctcgatgccggtatcagcctggaacttcttgagcaaattgacaggcaggatgttcggccagcttccgatatgtagctcggcggcctgggtcgtgacagcggcaagaagcaacatcgctccgattgtttttcatgctgttcctattgcgtggagattggcgtggtgtatctcggactgctcggccctggatcttcttttacctcgcgcaccgatgatccagactaccgtcagttggattgtcgaaaggccgatgacgacggttgacacggcgctgaccttgggtgtgattccgatcttcaatgcaccgaagatgtacatcggcaatgtggtcatgccggcgccggcgagaaagtagctggtgacgtaatcattcatcgacgcgacgaatgacagcaaagcccctgcgatgatgccgggcagagccaaaggcgcggtaatttgccgaaatacagcccatggcgtggccgacaggtccgcggccgcctcgagcagcgtgcgatcgatcgtcttgagtctggccttgatcggcagataggccagcggcacactgaacaccacatgagcaaacagaacggcgccgaatccaagctctgactcgaacatcgagaacagcatcatggtcgcgatcgccagcacgatttcaggtatcgcgagcggaagcgcaatgacaagtccgaccgaatcgaaaccacgccggtcacttctcgaccaccaggcgaccgccgcgctcgtcgcgagcgtggtggagagcaccgtcgacgccagcgccagcaacagtgaattcttcgcggcgcggaccagtgtcggatcggaccaggcctcgacgtaacctcgaatgccaaacccgtcccatatgagggccgacgggccgacgttgaagctcatcgccatcacggtcagcatcggcagatagaggaacaccagcaccgcgcacgcgatcgttgcggtcagcggaaaccggcgcagttcaggcgaaatcatgaacgcgctcctgccgttggaagagcgaacctagtcgagacgcgagcatcgccagaagcacagcggcgagcaacgcgaacgacatcgcggcgcccaaaggccaatcccgtccgccggcaaactgaaagtcgatcagattgccgatcatgaaagcgtggttaccgccgagcagacccgggatcgtataggaacccagcgccggaacaaagacgagcccgattcctgccatgatgcccggacggcaacacggtacgacgacatggaccagtaccgccggcttgtgtgcccccagatcgtaggccgcttcggccaaccgccagtcgaagtcatcaagcgcagcgaaaatcggcaggaccatgaacggcgtaaatgcatagacgagaccgatcagcgtcgcaagatcggtgtagagcaatccgagcgggccatgcatgaggccggctcgggacagcatctgattcaagaggccgtcgtccgcaatgacgatgatcaatccgtacatctggacgacgacgcaggtccaaaacgggatcgtgatcaggatcagcaacgtggccttccacttcagggagcgcgtcgccatgaacagcgccgtcgggaacgcgatcagcagacatcccgcggtggtcagtacggccatggtcatcgacctgatgaaaatggcgagataaccctgctgaaggacgcgtccccatcccagtcccgatcgaagagaatccgctcgtatgccccggcagtgaagtcgccccacgagacgccgccgaagtcgcgcggtgcactgagcgagaccactgccagaacgatcatcggaaggacaacgccggcgatcatgacgagcgccgtcgggctggtcattggccgccatgatttcagcagattgagtattgggactcggcgcactgccaactacctcaaatcattcagttcgattggcaagaagcgtaccaaatcgatggcatcatttatagtcggcatgtgtgccgatcacgccaatgtgttacccctgtgtgccatttccattataaatttgaggaaatgtattttattgcggatcattgcatatttagaaatttccgcgctcgagtcttactgagggtgccatccataattttcggggctaaccgaacatttcgtctaaatgttcggtcacggtgctcagcgtcatgcgccgacgccaaaccgataattcgcggggtgtgcgacgacgtcgccggcagaatcgcttgactccagcctccggagcgaacacgtggatgccacggtttccatgcagcgccaactgcgccatcgcgaacaacaagcgacgcacttcaaccggatcaataacactcacaataattctgttgacggatgttcgttatggtgctccggtgaccaccacggctatctgacacccgcgatcacgttcgttggagaatttgcaaaaatcgtgagatagttatccgagtttcgccacgtaaatttcacataacgagaagagagacggtaaaaacatggccactgctgagcagctagaataccgaccgatgactgagcgcgacgtcggcgcttttatgatgtgcgattctccgtgagcgagaatagaatccatccccaccaggttcatcttctgaaccgcaacctcctgatcgagaaaatcaggcagggaggtggctggatctgtgaatgtggcgacgaggtcgccggggtctgtctgccagtcatcaccgagacgccgttcatctcggccttgtttgtggcacctcagttccatggtgtcggcatcggccgcgagctgcttgcccgtgcgcttacatggctgaaagacaagggagtgaatcatgtcacccttgtgaccgatccaggctcgcgggccgatggcttttaccagcgtcttgggtggaagcgcggcgaattggacgagtacgggtgtcaggtcgtatttacaaaattgcttgtggactagaatccaaggagtcgaatgaagccggtagccgacgcgattcgccgcactgctgcgcaatgtccagcgccactgcacaccatcttcatcacgctcgatttgatgaagcgcatgggtgttccggtcgacgtcttgctgaaaggcaccggcatttctcccgcagacatcgagcgacccggtgcaatggtgacgcatgcacaggaaatggtcctgtttgcgaatgcgctggaagcgaccggcaacagcgcgatcggactgcatatcggatatgcgatcccggtgacgtcgtacggcctgcgcggccacgcaatgctggtgagcccgacgttgggcgatgcgctgcgcatgggattcgagcacccgttgctcgggatcagttatttcagaatccggataaccacaataggcgagaccgcgagaattatagttggcggttatacctatcgtaccgacctgcttgtcgtaaataccgatatggtatttaccgccttacgtcgacagatacgcgatttgatcggacacaatccagatttttccagaatagggtttgtttttcccgagccgccacacgcgagttcttacgccgaatattttgactgtcccatcgaattcgaggccgacgaaaattacctcgaattcagctcatcggtgcttgatattgcccttccgctcgcccatccgatcgaattcgaagtagcaaggaaagcatgcgccaagcgcgaatttgaactggcgcactgggttccgtccgacctcatcgggcggctcctcggtcttatgtatgatgaccctacgtgccaggatatcgcagagcaatccagaaagcttggaatgtcaatgcggagtttgcagcggaagcttcaggaaatggggacatcgtttagcgacctgtatgatattgtccgacaagatctgacgtcgcggtatattgcggaaaaggaatatacaatcaaggagatagccgccagattggggtataagaattcctccgcattcagtcgggcaatgaaacgatggtcaaaattttcacctgaatgatcgcgacatttcattaccacccctgcctcgattccacatgcgagaagaagtttgacaactttttgactgtatggaaaaggacatggcagcgtgcaggccgacacgacgcgcaatatgggtaaatcctggcgcttcctcgccaacccggccgatagttccgccgttctgacctggttcggcgcgctgagcaatctttcgtccggggcacgtcaccgtcatacaaggtgacgcgctttgggcgcctgcttctgcgtagccgtcgaccagtcgcggctacggagggaagttcggggcagtatgtccgcgcgtcagaccggttcggtcgcaacgcccggcgaattcagttcacgccaccggttcggggtgatgccctcccaatcgcggaacgcgcgatagaacgagctcgtgtcctggtaacccagcaggcaggacacctcatcgattcccgcggccgggtccgcaagcaaccggcgccagagctcctgtcgcgcttcggcaagcagatcccggaatgtcgtgccttcgtccgtgatgcgccgttgcagcgtccgctcgctcattccgaggtcgcgcgcgacgcccgacagttccggccggccgcttgcgaggcatcgcttgagtacgactttcacctgctcgcggatcgggctgcgcgcgtcgatttccccagcgccgccgtcagtgcggggtcagcatgtcgagcaattcaggattgtggccgggaaacggacggcccagatcggtcgatttcagcacgagcgcattgcgcgaagcaccgtagcgaatcggacagccgaaatacgcgcggtagacctcgtccctcgggccggtacgaacgaactccacgcgacgcggcgtcacgtgttgcccggtgccgcgcctgccgagttcgagcagcatcgcgaacgtgacgtcggtcgcaacggcgggttccggttcagttgcgtacggccaggccgaggcaaggatgcattcgccgccctcttcgacgatatgcaactgctccggcgtgcagagccgcttgaagcgggcaacccgctcgaggccgtcgcgatagtctcgcgcatggaacgcagccacgatgaaaggggatgcgttgcggcttcgctcccggtcaccagcgcgatgcccagaccgggctcgggcgccagctgcccgatcgctttccatagcgcgaagtactggtcggtgctcacgagcgcttgcggattcaggtgcagcgtggcgggtagccgggcctgacgcagtaccgcggccggcgccaagccggcgtgcgccatcgagcgccagaacgcccgcggtatcttgcatctgtctgccatgactgcgcccatcgttacccctgcgtggaaaagcccctgccgctcgtgcgcccggctcgtggcgggcgcgcggatcatcctagcgcatctggctcatgatgatgcggtcgaacacgcggtcgcccaaccaggcgcggatcaggatcatcggtttcgcgtacttgccggcgacgtatcgcgtgcgcggtttcctcgcgcgcactgcctgcgatacgacgttggcgatgacatccgggtcggtgccgcgtccgttgccgtaggcttgctgcgtcgccttcgcgacagcctggatcagcttcgcataggcgccgctgccggagcgggtcagcaggctgcgcgaaaccacgtcgccgaaccccgtctcgatcaggccgggctccacgatcacgacgcggatgccgaacggcgcgagttcgagccgcaggcaatccgaccagccttcgagggcatgcttcgtcgcgtgataccacgcaccgagcagcgtatagatcttgccgcccatcgacgtgatgttgacgatcgtgccgctgcccttctcgcgcatggcgggcaggagcaactgcgtgagacgggccgtgccgaacacgttgacctcgaactggtatcgcgcctcctcgatgccgatgtcctccaccggcccgtacagcccaaacccggcgttgttgacgagcacatccacgcccccggtttccttgagaatcgtctcgacggccgccacgatttccgcatcgcgggaaatgtccatgcgcagcagcctcgcgccgaggcgttcgaggtcgatcatcttgtccaggttccgtgcagccacgtagacctggaagccgtcctggatcaattgccgggcaatttccttgcccatgcccgaggaggcgcccgtcacgagggccgtcttcttgcttctatcaaacatcgtggtctctcaccgagttctgactggcgtgaacgttactcgccgcacggcgccggcgcactaacgaaaggcgccactctggtcgcaattcgcgccaaggcgagcgcggcggccgggaagcgctccgccgcgcggcccctgttccgcgaggaatggcgccatccgtcactgtgcgatccagcctcagtccttacgagccggttgtctttcggagacggatcggcggctctctacgacggctcatccggacgcacgtccgcctgcaaggcgaccatcaaggacggaaagatgcttctacacggctacctcggcatttccgcgctgggagagaccagggtgtttcatcgcgcgaacgggtagcgaaatacacgtcgaaaggcaccaagaacgccccaacgccgtgggtattcgtcggcggattttctggagtgctccgatgaaacggacaagctatccgaatacccgagcccataccgcccgaaggcgtcgcgcgcggtcttcgaggagataggaggccgccagcgtcaggagacctgaaattgcgcccgtcacgatgtgctcgacataggggatgcggtagtgactcgtgtgcgagtaggcgtcgcccaacgtcgtcaggcagccaacgatcagcgcattgccgtatcgatgcgcatagagtttcgccatgggcgtaaacgtcaaaaggacggccaggagtccggtaagcagacctgtatgaaatgcgatagtccagtgggcaacgctcatgatgttgccccagctccccggcatgcaggtcatgcatgcactggtcggctgccagaaacgctggataaacagtctgacgcggtgcttccactcggttgacatgatgcattcccgtcgatgccgttgtcatggccaacgccgccacacgtatcgttgaagcagattccacacccttcagcgagcttgccgcccccgcatggacgggctggccgtaagccagagaggcagaacaataacccggacatggggaatactactccacgatcggagtgccgctgcttcgaccgaggccggcattcgacgctcgcgcctgtcggtgcgattcgatccatgacgggcatcgggcgtcgggctttcgcgcgaagtcgacgtccggcgtcaacggtaaattcagccggtgtatcgacgttcgacgccccgcctgaccggcaaacgtccccgtcatatagaatgatgcgctttgcccgtacgcccatgtggttcaagaatcttcagcttcatcgtcttccggccccttgggccgttaccccgaccagatggaagcctggctggcgccctacgcgtttcagccgtgcaacagcatcgagatgcagcgcttcggatgggcgtcgccgcgtgacgacggcgcgcttgtgtattctaacaaccggcagatgctgctggtgtttcgttcggaaagaagctgctcccggcgtcggtcatcaatcaggtgaccaaggctcgggcgctcgaggtcgaggagcaacagggcttcaaggtcggacgaaagcagctgcgcgaactcaaggagcagatcaccgacgaactgctgccgcgcgcgttcagcattcgccgcgatactcgcgtgtggatcgatacggtgaacggctggctcgtcatcgatgcggcttcacaggcgctcgccgacgagattcgcggcctgctcgtcaaatcgatcgaccagttgccgctcgccggcgttcaagtggcgcattcgccggttgccgcgatgacggactggctgctgtccggcgaggcgccgggcggattcaccgtggaccaggacgccgagttgcgttcgagcggcgaaggcggcgccacggtgcgatacgtcggccacgcgctggaagcgagcgacatgcgccggcacatcgaggccggcaagcaatgcatgcgcctcgcgatgacctggaacgaccggatctcgttcgtgctgacgccgtcgctgacgatcaagcgcgtgtcgccgctcgacgtgatcaaggaggcggcggatcccaccgcgcagaacgacgatgagcgcttcgattcggacgtcacgctgatgacgggtgaattggcgcggatgctcgccgatctcgtcgaaagcctcggggtgaacagcagcacgactcgattcaaaaggcagcagcctgaccgccgtcggttgtcgcggatcatggctgctttgccgcaatcgctccgccacgcattcgtctgccgattcgcctgccggccccatgcgcgcgtccggctgatggctcaggggatgagccgggccgaaccgtccgtcgatccggcacacgcttgcacgatctgcgccccggcagcgtcgtcgagcatcgacgacgccagcagcgcgcgcgtgtaagggtgtgacggcgaattgagcacctgcagcgtgtcgccttcttcgacgatgcgccccgcctgcatcacgatcacgcggtgcgccatcgcgcgcatcacggccagatcgtgcgtgatgaacaggtagctgagccgataccgggcctgcaggctcgtcagcaacgccagcacctgcttctggatcgatacgtcgagggcgctggtcggctcgtcgagcacgagcagctcgggctccaccgccagcgcccgtgcgattgcgatccgctgtcgctgcccgccggagaactcgtgcggatagcgcagcatcgtgtcggccggcagcccgacttcctccagcaacgccgcgacgcgcgcggcgcgcggccccgccagttccggccgatgcagcgcgagcccttcgccgacgatctgctcgatcgtcatgcgcggcgccagcgaaccgaacggatcctgaaacaccacctgcagccgcccgtatagcgcgcggcgctccgctttcgcgcgcagcgccgcaagcggcagcccgtcgacctcgatctcgcccgacgcaggccgctgcaggccgagcaccgccgacgcgagcgtcgatttcccgagcccgattcgccgacgatcccgaccgtctcgccacgacgcaagctcagctgcgcgtcgtgcaccgcacggaatgcggtctgcccgaataccgcgcgccagcctttcgcggtggtccggtagtcgaccgcgagcgcacgcacgtcaaggatcgttcgcgcgtcggccgcgaccggctcgatcgcgcggcgcggcgcactgtcgagcagccggcgcgtatagggatgccgcggcgcgccgaacagcgccccggtttcgtttgcctcgacgagcacgccgtgctccatcaccgccacgcgctgcgcgaagcgccgcacgaggttcaggtcgtgcgtgatcagcagcacggccatcccgcgctcggcggcctcctgctcctgcaggtcgagcaacaggtcgacgatctgctggcgcacggtgacgtcgagcgcggtggtcggctcgtccgcgagcagcagccgcggccggcacgcgagtgccatcgcgatcatcgcgcgctgccgctggccgcccgacaactggtgcggaaagctgtcgatgcggcgctccggctccggaatcccggtgcggcgcagcagctcaataccgcgcgtccgcgccgcgccgggcctcagcccttcatgcagccgcaggctctcggcgatctgccggccgatcgtagccagcggattgagcgccgtcatcggctcctggaacaccatcgcgatgtcggcgccgcggatgccgcgcatctgccgctcgctcttcgtcagcagatcctcaccgtcgaacagcacgcgccccgacaagcttgcctgccgcaccaaccgcatgatcgacagcgcggtcacgctcttgcccgagcccgattcaccgacgagcgcgacccgctcaccgcgttcgaccgacaggctcagctcgcgcacgaccgtccggtcgccgaatcgggcggagaagccatccatttccagcaacgggttcgtcatcatcggcctccgccaaatgccgagccacgcgtgcgtgcatcgagcgcgttgcgcagcgcgtcgccaatgaaagtcagcagcagcagcgtgacgaccagcgccgcgaaagccgataccgaaatccaccacgcgtcgagattgttcttgccttgcttgagcagctcgccgaggctcggtgtcggcggcggcacgccgagccccaggaagtcgaggctcgtcagcgacaggatcgccgcgctcatccggaacggcaggaacgtgatcaccggcgtcaggctgttcggcagcacgtgcctccagatgatctgtgcgttcgacagccccatcgtgcgtgccgctttcacgtagtcgagcgcgcggttgcgcaggaattcggcgcggacgtagtcggacagcacgagccagccgaacatcgacagcagcacgaacagcagccacagcgacggcgtgaagatcgacgcgaagatgatcagcaggtacaggtcgggcagcgcgctccagatctcgatcaggcgctggccgaccaggtcggtacggccgccgtagaagccctgcaccgcccccgcgagcacgccgatcagcatgcccgacgcggtcagcgcgaacgccatcagcaccgacagccggaacccgtacagcagccgcgcgagcacgtcgcgcccgaactggtcggtgccgagccagttgctggccgacggcggcgccggatacgggcgcgaagcgaaatagtcgatcgtgtcgtaacggtatcggttcggcgggaagatcgcgaagttgccgcgcgcgtcgaggttcgcgcgaatggcagggtcgagatagttcgtcttcgcgggaaaatcgccgccaaagcgcgtttccggatagtccttcacgatcgggaacgcgtagtgcccgtcataccgcagtacgagcggacggtcgttcgacagcacgtcggcgaacaggctgatcgcgaacagcgcgacgaagatcacgaaactccagtagccgagcggctgcgcgcgaaaacgcaaccatgtgcgccgccagggcgacggcgattggccggcgcggtcgcgctcagcggtccaggctgttgaactggatacgggggtcgacgaggacatagcagatatccgcgatgagtttggtcagaagaccgatgagcgtgaacaggaacagcgagccgagcacgaccggatagtcgcggcggatcaccgagtcgtatgacagttgccccatgccgtcgagcgagaacagtgtctcgatcagcaggttgccgttcaggaaggcgccgacgaacgcggcaggcagcccggtcagcagcgggatcgccgcgttgcgcagcacgtgcttccacagcacgtcgcgctcgggcacgcctttcgcgcgggcggtcagcacgtactgtcggccgatttcatcgaggaacgtgttcttggtcaggatcgtgacgatcgcgaagttgccgacgaccgacgccgtcaccggcatcacgatgtgccacagatagtcgagcgcctttccgatcagcgtcaggtcgtcgaagttgtcggacgtgagcccgcgcatcgggaacacctgccagaacgtgccgccgccgaacagcatcagcagcagcacgccgagcacgaagcccggcaccgcgtagccggccagcaccagcacgctcgtcacggtgtcgaaccgcgacccgttgcgcacagccttcgcaatgccgagcggcaccgacaccaggtacgtgaggattaccgtccacatcccgagcgtgatcgacaccggcagcttcgagcggatcacgtcccacacgcgagcatggacgaaatacgaatccccgaggtcgaatcgcgcgtatgccttcagcatcatccagtagcgctcgagcggcggcttgtcgaagccgaactgcctgcggatctgctcgacctgctgcggatcgacgccctggctgccgtggtagcccccgcctccgccgcccgcctcgccgccgtgcgcgctgccgtggcgcaactgcgtgaggacctgttcgaccgggccgcccggcacgaactgcgtgaccgcgaacgtgatcgtcacgacgccgatcagcgtcgggaccatcagcagcagccgccggaatatgtagccaatcatcgtggtgctctccgttccgtcatgtaccggaaacccgcgcggcgcccgccggtttcttccggtaccagtagctgatgatccagtcctcgtactggtaggaatccggaacgatggccggatgtccgtagctcgccttgtacgcgatccgcgcgttcggcaggtagtaatgcggcacgaggatgtacaggttgatcagcacgcggtcgagcgcgtgcgtggccgtctcgagatcgtcgagcgtgtcggccgcgagcgccgcgcggatcagtgcgtcgaccgccttcgacttcacgcccggatagttctcggagccgacctgggacgccgccgcgctgccgaaacggcgtgcgagctccgccccgggatcgtgacgggcgaatagatgaaggtcgtcatgtcgtactggaagttgtccaggcgccgctggtaaagcgcgctgtcgagctcgtgcagcgacgcgcggatgccgagcgtgccgagcgcctggatgtacggcaggatcaaccggtccatgcccggctggtcgtcgatgatctcgatcgtcatcggcgtgccgttcgcgtcgcgcagcgcaccgtcccgaaaatgccagccggcctgcgcgagcaggtcgcgcgcctgcttcaggttcgcgcgcaacgagccaggcggcagcgtcgacggcggccggatcatcgggccgaacacctcggccggcagttcggcgcgatacggcgcgagcagcgccagctcgcgctcgctcggcatgcccttcgcgccgaacgggctcgccgcccagaagctgtccgtgcggcggtactgcccgtagaacatcatccggttcatccagtcgtagtcgaatgcgagcgtcaatgcatgacgcacgcgtacgtcggagaactgcggtttgcgcaggttgatcaaaaagccctgcatctgtgcggggccgtccgggaattcccctgcttcagcatcccgttgcggaaattgcggccgacgtaacgacgtgcccattgcgtcgcgctgtattccatgcgcgcatcgatgtcgccggccttgaatgcctccagcatcgtgtactggtcgagatacagcttgaacgacacgcgcgcgaagcggtacatgccgcgccgcgacggcaggttcgcggcccagtaacgcgggttgcgcacatagacgatctgcttgtcgttcttgcgctgctcgatcaggtacgggccgctcgcgatcggcggcaccgttgcgatctggtcgaacggcggccgcgtgccgtcggcccgcatgccccacttcggcgagaacaccggcaggtcgcccgcgatcagcgcggcgtcgcgctccgcatgcttgaactcgaagcgcaccgtgtggccgtcgacggccactgcgcgccggatcaccgaaaactgcgcgttgaagagcggcgacgcctgcgggcccgacagcgtgtcgaacgagtatttgacgtcgtccgccgtgatcgggtcgccgttggagaaacgtgcggccggatcgatgtggaacgtggccgagagtccgtcgggcgcgacctgaacgtcgtcggcgatcaatgcatactcggatgcgagctcgtcccagctgcgctgcatcagcgtgtcgaacatcaggttcttgatgtccggtgcgggcgagccgcgcacgaggaacgggttcagcgaatcgtagctctgcgcttcgttgtagttctgaaaggccagcgtgccgtcgtccggcgcgtcggggtccgcatacgcgaaatgcgtgaatcccgccggatacttcggcgcgccgaactgcgcgatcgccggcgcagccaccgcgcccgcgatcgcgacgccgtatgcgagcacggctgcgcacacggtgatcgcgccccgggccgcgatcgcctgcgcgcgccgcgcatgcaacatcgatactgtcatcatcggtcttcgtgtgatcgcaccggcgtgcggccggtgccatgtcgattcgaaatgcgggaacgcatgcggtcggcgaccgcaacggccgaccgcatgcgcgggcacgcgccgtcagaaccggtaggtcgcaccggcctgcgcaaagcggccgacgtacgtgtacagcgacgtgtcgtagccggtctggtaggccgcgttcatgtacacgggatcgaacggcggcttgcggttgaagatgttgttgatgcccgcatacagcgtccagtgcttgaacccggtatagctgacggtcatgttgaactggctgtacgacgcgacgctgtcctgcatgttcgggtagttcccggccggcaggatcgcctggctgtacgggcccacgtagatccacgtcagcgtcgtgttccacttccggtagttccagttcaggtccgtattgcccttccagcgcgggaagctgccgccgaacggctggttcaccgaaccgttgttgcccgcgaagtcggtatcgacgccgcccaccggcatcttgaagtgccacacgtacgcccagtcgcccgacagcgtgaacgtgccgatcgccgtcttcaccgactggcggaacgtcgtctcgaagccgtccgtgtcgagatgcgacaggttcttgtacggcatcaccacgtatgcgatcgaaccgttcgggttgcgtatcacgcgagacggatcgttcgcgtcgaccacgctctgcacgtcgtcggtaccgatcacgttgtcgacgtggatcttgtaccaatcgaagccgatgtcggtcgtacgcgtcggcgacagctggaagccgatgttgtagttcttcgtgcgctcgggctggaggttctggttgcccgcctggatttcttccgtcaggttgtacgagccgggcgcgttccgatcgtgcgcgtcgatcacgccttgcgtggagaaggtacgcgacgccgtattctcgatcagcgtcggtgcacggaagccgcgcgtgtacgacgcgtaggtcgtgaactcgcgcacgggctggaaacgcagcgcgaagcgcggcgagaacgccccgccgaaatcgctgtagtgatcgtagcggcccgactggctgaaggtgaggtttttcaggatcggtacgtcgagctggtagtagaccgccgcgacattgcgctggccgttgaccgactgcatcgccggccggatgagcgtgccgtccgcccagcccgagcccgtgccgatgtactgggtttcatgcaggaattgcgtacccaggccaaggccgacgttgccggtgggcagcgtgaacaggttcggcgtcgcaatcgtcgcatcgaccgagtcgagtttcgtgatcgcctgcgtgctggtgctgccataggcgccatcgaggccatgcggcgtcgcggccggattcgcgaagtcgaacccgccgttctgaacgatgttctccagcgcggatgcccgcatccggttcgagaagtcgttcgacacctcgctctgcgagtgcgagtacgccaccgaccaatcccagtcgcccaccttgggtgtggagaaggtacccttgacgcccgtcgccgcccgccagaaattcgcgctcgtgcgaacagactgcgtgtctccgaacgtgtagcgaagctgcgtcggcgtgccgaacggattgtacggattgctgcccggcacgacgttcggcaccagcttgacgcccccgtcgcgggatcgtacgtctgcgtattcgaacgcaggcgctcgacgccggtgttcgtgaccgtcgtattgttgctttcccacaggtcggcgaatgcctgcatcgcgtcgttgatcttgaagtcggcatgcaccttcgcactcaagcgttcggtccacggcgagatcgacgatgcgtatgcggtgttgttgccgcacacgctgccgctttcgccgaatgcctgcgcggtcgagccggccggaatcgccttgccgccgcgcgggcatggcgacagcggcacgtcggtgccattgcgccgccagtacgacagcgattcgttgttcaggccgccggggaaattcgagaaattctggttctgcgacatgtcgcgatcggacgccagaatcccgttggacttgtagtagctgagcgcagcggtcacgttgaagcgatccgaattcaggtcgccgatgccgcccaggatgctgaactgggtcgtgcccgcaccgccgccgccctgcgtcgcgccgccgtagctgccgccaagctcgagcccctggaagttcttcttggtgatgatgttcacgacgcccgcgatggcatccgagccatactgcgacacagcgccggtcttgacgatctcgatgcggtcgatgatgttgatcggcagcgtgttcaggtcgaagaactggtcggtgccgttcacggcgaacgcgtagggtgccacgcgctgcccgtccaccagcaccagcgtgtacttttcgctgaggccgcgcaatgcgatgcccgcaccgcccggcgcgaaactgccctgcgcgcccgagccttcgccccagctgcttgacgagttcgccgacacgccgcgcaggaaatccgatacggtcgtatagccgctgttctcgatgtccttggccgtgacggtctgcacttggttgaagccgaccttgtccgcactgcggatcagcgagcccgtcacctcgaagcgcttgatctgcgcgaccttgccctgcgccggcgcgccaccggccggcacgccggctccgggcccggctcgccggtcggcacaggcgcatcctgcgcgaccgccgtcgcaatctctgcccccgggcgacggctgactctgcgcgaatgccggcgccgccagcgtggccgtcagcgccatttccgcccagatcatcctcttgatagccaacgccaaaactttctgcttcatcttggtccactcgttcatcaataagaacccaccggttttgcccgggatcttgtgaatccccgcccgcttccgggccctgcgcaccggccccgtgatttccgacctgccacctgcactgcctcgagcccgccggcaacgcgacctgcgccccgtgttgccggctccttcgttcggcgcggccatcccgaccgcacgcctcacacgttccatccaaaaacattcagtaatacttatgtaagcacccggtgaaacggatgcgttttcgtgttctctcaggctccggccggcgccccgacccagacgatcaccgcttcctcgttggtggcgttgctccagacctgggtcggggtcgactcgtagtgcgcggcatcgcccgctttcagcacgacggtgcggtcgtccagcgtcagctcgagctcgccgttcatcacgtagacgaatgcctcgccggcgtaaggtgctgcttcaggcgtggcccggccccgtggaatccggaacagcctcgcatccagcttcgttccgctcgccagatgcgaaagctgtgcgaacgcactggcgagcgactcgacgccgcagtgctgcagcgattcgcactggcacgccggcggcatgtcgggcgacgcgccgacgaaatggtcgatcgtcacgcccagcgccttcgcgatgccgacgagcgtcgcgatcgacggcatcgcgcgtccgcgttcgatctgcgacaggaacggcttgaaatgccggccgcagcggcggtcacatccagcgtgagcttgagctgccggcgcagcgtgcgaatcttgtttcccatcgaggtggcgacaagcatcgattcatcggaagacgaaaccatagtgagacacgaacccatagtcgaaactgtttgatgaatacgctccccggtcaacgcgatcgcagtgcgcattcagcgcgactgcgtaccgacggaaaccgtgatcgcgcggcggacattcgatgttacggctttcccggttttcacatcgcattgctacatttgcactactgatcgatatggattcccgttggtcgtgtcgcatcgtccgctccgtcaagggttcgtcgggcctcgcaaggtgccggtctccggccctgccgccagcttcacggcatgtactgctcgttgccgatgaggccgatcttggtcgccccgacacgctgcgcgcttgccagcacgccggcgacggcccggtacggcgcgagcttgtccggacgcaggcggatctccgcctgcacgggctccgcggcgacgtgcgcgagcttctgctcaagcgccgcgcgatccggcactcgcgcgccgttccaggtcgttgcgccatcggcggcgatgtcgatctgcacggcctccggcggcttcgacggtggcggcggattgccgaccggcaggtccatccggaccgagtgcatctggatcggaatcgtgatgatcaacatgatcagcaacaccagcatcacgtcgatcagcggcgtggtgttgatgtcgaccatcacgtccggctcgccgccgcccgaagatacgttcatgcccatcgtcgactcctacccgccgcgcgccggcggctcggtgatgaaagaaaccttggcgatgcccgaccgttcgcacgcggtgatcacgcgcccgatgaattcgtagcgcgtgttctcgtcgccgcgtacgtgcacgtcgggctgcggtgacatctgcgagatgcccttcagcttcgcgagcagcgtcgggccgtccacgtgcgtttcgccccagaagaattgcccgtcgcgattcaccgcgatttcgacgcttttcggcgtcgtctccaatggctgcaccgtttccttcggcagctccagcggaatcgtgtgagtcacgaccgggatcgtgatcaggaaaatgatcagcaacaccagcatcacgtcgacgagcggcgtcgtgttgatgttggcgatcacgtcgtcgttgtcgtcctgcccgacgttcatggccatcgcgcactcccgcctgcgtcagtgcacgagcgacgcggccggcgtaccggcggcccgcaccgtgcgcttgccgcccgcgagcagtaccgtatgcagctgtgcgccgaagttgcgcacccgctccatcagcgacttgttgcgacggaccaggaagttgtagccgagcacggccggcaccgcgacagcgagcccgatcgccgtcatgatcagcgcctcgccgaccgggcccgcgaccttgtcgatcgacgcctgcccggcgatgccgatggccgtcagcgcgtgatagatgccccacacggtgccgaacaggccgacgaacggcgcggtcgatccgactgtcgcgaggaacgcgagaccatcctgcagccggttcgacacgttggtaatcgcgcgctcgaccgagacgtcgatccacgtgttgcgatcgactgcctcaagcaacgccgcgtcgtgatgctcgccggcctcgatcgcggtctcggcgatgaaacggaacggcgacgcctcgtcgagcaggctcgcgccggccgacagcgacggcgcggaccagagctgctcgtccgcgagcttcgcacgccggttcgcgcggaattgctcgaggaacttcgcgatcatgatgtaccagctgcccatcgacatgatcacgagcagaatcagcacgaatcgtgcgacgaaatcgccgttcttccacagcgcgccgagcccgtacggattctcgacggcctgcgtcgccgccggtgcaggcggcggcaatggctcgtccgcagccgcctgcggcgcggacgccgtcgcggccacggccaccggcgcgctcgcctcggcaaacgccggctgcggcgcaatcagcgcctcgagcgcgacggaggatatcaacatgcaggccgcgagtgcggccagtgaacgctttgccatacctactccacttatttcgtttaactgatcgattgaaattcccgtcctgccgccccagggccctgcacgggtcagttcaggttgaacgagaacggaacctggacgcgcaccggctgcccctgcgccatgcacttgaatcgcttgaccgtgttgtaggcagcgcgatccaggactggatcggccgactgcgacactcgtacgttggtgacgttgccgtccgcatcgacgacgaattcgatcgtgacgtcgcccgtgatgttgttttcctgcgcttccttcggatactgcatcgatgcgcgcatctggtcggaattcgggcagaccacgccgacttcatgactgaccggcttcgccgccggcgccggcggcgcgacgacgggtgcctgcacggccggcgcggacggcacgggcgcggcctgatgcgtgatcgctgcctgcggaggcgcctgcaccggtacctccgccggcggcacgaatggcggcggcggcaacgtcgccttcggcggcggcagcttgaccaccggcaaaggcggcgggggcggcggcggcggcggcttcaccggttcgatgatgcgggtttcgatcggatgctggataacctgtacgaccttggtcgcgaggccgttgaggagcgcgtagaccagcaacacatgcagcagcagaacggccgcgataccgccgaagcggcgcaccgggttccgctgtttcccgccgaactgccgctggcgccgggcctcgccggtccgcctccggacgcgagcacgccatcctcgatcttgatacccaccttcagtccccaacgcgaatgtcgccgatgcacgatgccccacggcccggatagcggcagtgtctgattcgaaacccggaaagcccgatttacttattttcgaaaatacgattcctgcccgtcgatcgctcgatacgggaaaatacctgctcatcgaaattgattagattccggagaatgaaacggatgcccgtccgctcgagcagagaccgacggagtgctacccagacgcaatcatgcgaatggaaggcaaagatattcgataagaaattaatccatcaaaagacgccacccgttgattacagaagatatcaagaaaaattttgaccgtcaaacttttttgatggaaagacaaaagtttgatcacatcaaacttttcgaattgacgacgacgaatgcgcgagtttaattgcatcaaacattccccatttcagtgcgcacgataatccgaacaagtttaatcacatcaaacttccacatgaatttgttcgtcggaagcgatgcttcccgaagcaggagtcgactcgaacgggatcggcatctggcgccgtgcatcgccgccgaactgccggggcacgcatcatccgctgcccccaacaccgcgcacgtcgtacattccggcggattgcaggcccagtggtcgcgccggttccatgcacgacgatcgaccgttgcggcacgcaacccggcggagtgaacccgcggcgaacgaacagccgcaacctcgcacaccgccttaatccggatgtctttccccgttttcaaaaaacaaatccaattccagcgtgatttcaatttaccccaccctatccatatcaatacaagcatcgatcatttgcccgaccaaaaatcgatcgataaagtctcgccacgtgcgccgaccattaatctcgaattcggcacccgatggaaaaattgagccacccgtcacatttcggattacatccgtgattcctggtgcccgatccgaatacaggaattgcgcgaacgacaggggttgcgagtcgacatgccatcgcaaacggcatggatacccggcaactgctaaccattgaacttgctcgtcaacacaacttgaagatgcaaaacacgtcgctccatatcaagagcgtgggcgcaatcgcgctctgcctgtccggcctcgcgacaccctggatgcccgtcgcggcacaggaagccgcgtcgggagccgtcgccgccgccgcgccgccgaatgcggccagccctccgcgccggctcgtggcgaggctgccacgcaaaaaccggccaccgcatcgctgaaggcgtttgtcgtgacgggatcgcgcattccgcgctccgagaaggaaggggcgacgcccgtcaccgtcattaccggtcaggagctcgaatcgaaagggtaccgaaacgtcttcgacgcgctccagtcgcaaacccagaataccggcttcacgcaaggcgccgactacggcaacacgttcacgccggccgcgaatgcgctcagcctgcgcggcctcggcccgaaccacacgctcgtgctcgtcgacggccggcgcgtggcggactacccgatcgcatacgacggcaacgtcaacttcgtgaacctggccaacattccgtcggcgatgatcgaccgcatcgaaatcctgaacggcgcggcctccgccgtgtacggctcggacgcgattgcaggcgtcgtcaacatcatcatgaagaagcacatcgacggcatcgaggtcaacgtcaagggcggccgcacctgggacggcggcggcggcaacgggcggctgcaggtgtcgggcggcaaggaattcggcgcgctgagcacggtgttcggtctcgagatcagcaagaccaacccgatctggtcggggcagcgcgacttcatggcgtcgtcgacgctcgaaggcgaaccgccgaccaagacctgggcgcgccagaacctcgacacgggccgctacgtcggcgccgccggcgcgtgcggcccgctcgccggcatcggcgcattcggcggcacctcgaccgtcggcacccgcaatggcgcgtactgcggcagcggcggcgcgcagccgtcgtactggacaacacaaacgaacaatgtcagcgagaacctgtacggcggcgtcgaataccggctgagcgatctcgtcacgctgttcggctccgtatcgaccgcctggaaccagaccgagaacaacacgcgcggcccgagctggacgtcggccgcggcgacgaccggctatttcttcaaccaggaaaccggcgcgaacgaggcgtggaccaagcgcatctcgccccaggagatcggcggcgcatcggtatggaacaagcactggaacgacgtcgcgggcaacctgatcaccggcctgcgcggcaaagtgcccgacagcagctggaactacgagctcacgtacagcgcgtccggctatcagagccgcgcgaccgtgccgcgcctgctgtcgaacgtcgacagctattacctcggcccgcagctcggcaccgccgccgacggtgcgccgatctatgcgcccaacgccgcacgcttcgcgaccccgctcacaccgaaccagttcgcgtcgatgtacggtgaatcgaccagcaggaacaacacgtggacgcagaccttcagcctcgccgccaacggcaacctgttctcgctgccggccggccccgtgcgcgccgccggcgtgatcgaatacggcacgcaaggcttcagcaattcgatcgaccctgccctgaaccagggcgtctactacaacgccgccggcgcgaccggtgcgagcggcaaccgcaagcgctacgcagccgcggtcgagctgcgcgtcccgatcctgagccagctgaccgcgaacgtcgcaacgcgctacgacgactactcgttcgcgggcacccgcaacaacaagctgacctacgacctggggctcgaataccggccgctgcgcgagctgttgctgcgcggcaattacggcacgagctttcgcgcgccggacatgaattacatcttcatgagccagtcgaagggctatttcgaatcgaccaccgactacttccgctgcaaccagtcggggaaatcgctcgcctcatgcgaatacgcgaacgtgtcgccgggctcgaacttcattcagaagggcaatgcgaacctgaagccggaaaacgggaaatcatggggcgccggcttcgtgctcgcgcccacgccggacatcgacctgtcggccgactactacaacattcgcatcgacaatctggtgacgaccatcgatccggacaacctgctgagaaccgaggccgcgtgccgagcggggcaactgagcgccagctcgcccaactgcgcggacgcgctgagccgcgtgatccgcaacccgctgacggccgtgctcgaccccggcgcgatcaacacgatcctcgtgaacccgatcaacgccgcgatggaaaagacgacgggcttcgacctcggcggcaaatggcgctttcgcctcggccgcgccggcaccttcctgctgagcgccaacttcaccaaggtcctgagccacaaataccagcagtacacgaacggcccggtacaggatctcctgcattcgctcgccaacccgaccggcaaccccgaatggccggacaagctcatgctgagcctgacctggtcgatcccgaagtggacgtcgacggtgcagctcgagcgctacggcaaggtaccgaacgccgcccagaccgcgtatctgacgccgaccacactcgcgaacctgagcatctcgcaccagttctcgcgggatacgtcactgaccttcgtgatgaacaacgtgttcaatacgatcaagcacgacgattcctccggctggccgtactacaccgtgggctactacatgccgtacggccgcacgctgtggctcgagttcagccatcacttcagttgatccggacgacacatgccagccgcggtatcgctggccggaccggccagcgttctgctacccgcatgtgcgcgcaacgcccctgccggcgatgatcgatatcgggacggacctgcccgcgcaggttcgtctgctggccgccggaaccctcgtggcgacacgcaccaccccgcttcactgcacgctaacccaggatgcaatatattttcccgcgatcgcgacatgccccggcaatcgagccgggaaatgcatcgtcgcggaatcgcatcctgttctttctcattcaccggcacctgaagtaatcaggggcatccgtatcggcactccatgttttcgaataaattcccgattctcatcgcagccagcgcaatattcgcggcccatgcatcagcacaagccaccgcgtccgcgcccatccccgaacaactgccatacgacatcccttacggcccgcccatcacgctgacgcaggcgcgtaccgccatggccgccgccgaaacagaggcgcgacgccgaaactggaaatacgcgattgccgtggtcgacagcggcgggaacctggtttcgtgcgacaaaatggacgggacgcaactcgcatcggttgaaatcgcggaggccaaggcgcgcgcgtcggctcgattccgcagacagacccgggatctgcaaaacgccatcaacaacggcgcgaccgccaatctcagcatcccggggattctcgcgggcgaaggcggcatcccgatcgtgatcgacgggcacctgatcggcgcgatcggggccagcggtggcgcgggtgtgcaggatagtgtcatcgcggcagccggtgccgcggcaatcaagtaagtcgcactccatcgagcctgtcgcaaaaccgtatcgtcgacgacgctcgcgctgccgtcgcactgctcacttcggcaatacagcagtcgaatcccgacgttttaattacttcaagctttcgattttgttctaaatcggtcgcagcgggccgataccgtgttgaaaatacgcgaatcgaccgatatcgatacactccgccgttgcgatgaaatttgaacgagacactggacgcccgaatggaaccggttccataatctcgtgcccgaatattgtctcgcgtgaacagataaaaatcttcgcatgcggcgcgtgcaatccctcgtccagccggcaattgtcgtttgccgatgcgctcggacaggtaacgcagcgccgcggggacgtattcgggtcgtttcggcccggagcggctcccgacgcggaatattcggaagaaagaaaacatgcgagcaacgactcgcgaaaaagacgaaaacgacatggccccacacaaaaatgaatcgcgtatttatgcgcgcgccggcatgacccgtagagcggtgctgaaaatgatggcggcggcgctgacgcaagtcggattgctcaccgccgcacccggacatgcattcgcgcagcagccgtcgctcgacacccggacctttctcgcgctgtcgaaagcgctcaccggccacgcgaatctcgacccgacgacggctgctcgcctcgtcgacgcattccgtcgcacggaccccggttttgccacgcgtgcagccgcgctggcgcaacgcgtccgcgccggccagacacccgcgcaactgctggccgatgccggcggcgcaggcctgcacgacacggcgctcgcgatcgtcgccgcgtggtacacgggcaccgtcggccacggccagaaggccgtgatggtcgcctatgccgatgcgctgatgtacgacaccgtccacgacggcatgagcgcaccgacctattgttcgaacggcccgctatggtggaccgccgaaccgccaccggccgatgtcgcgccgccccgcaaaacggttgcgtcagcaactacccagcacccgcaaacgcacgcctgaacctcatgagaactcctgtatttgaatcgaacggcgacgtatcggccgatgtcgtgatcgtggggtccggcgtggttggcggcctgatcgccgaccagttggtcagccaggggcattcggtgctggtcatcgaatccggcctgcgcatcgagcgtggtcaggcggtcgagaactggcgcaacatgcccttcgacaatcgcgtgggctccgacttccagggcctctacccgcaggcgccgaatgcgcctgccccgctgtattttccgaagaacaactacgtcggcctgagcgggcgggatggccagagtttccagcagggctatctgcgcaccgtcggcggcacgacgtggcactgggccgcgtcgagctggcggcacctcccggtcgatttccggatgaagtcgacttatggcgtcggccgcgactggccgatctcctatgacgacctcgagccgtactattgccgcgcggaagaggaaatgggcgtcgccgggccgagcgatccggcgatgcagtcgccgtcgcagcgcagccgcccgtatccgatggacatggtgccgtggggccatggcgaccggcgcttcgccgaaatcgtcaatgcgcatggttaccggtcgatcccgattccgcaggcgcgcagcacgcggccttggcacggccgtccggtctgctgcggcaacaacaattgccagccgatctgcccgatcggcgcgatgtacagcggtatccaccacatcgagcgcgcggagcgcaagggtgcgaaagtgctcgccgaatcggtcgtctacaagatcgacaccgatgcgaacaatcgcgtgacggccgtgcactggtacgacgcgtcgcacaagtcgcacaaggccagcggcaagatgttcgtgctcgcgtgcaacggcatcgagacgccgcgcctgctgctgctggccgcgaacgaacgcaatccgcacggcatcgcgaacggctcggaccaggtcgggcgcaacatgatggatcactcgggcttccactgcacgttcctcgcgaacgagccgatgtggctcggccgtggccccgcgcagagcagctgtatcgtcggcccgcgcgacggcgatttccgcgggcagtattcggcgaacaagatgatcctgaacaacatctcgcgcgtcgggccggccacgcagcaggcgctgaagctcggcctggtcggcaaggcgctcgacgaggaaatccggcgccgcgcgatctacggcgtcgacctgtcgatcagcctcgaaccgctgccggacccgaacaaccgcctgacgctcagcaagacacgcttcgatccgctcggcctcgcgtgccccgacatccactacgacgtcggcgactatgtgcggcgtggctacgacgcggcatgcaagcagctcacgcatatcggcagcctgttcgacgcggtcgagttcaacatcacgaagacgctgaacgcgaacaatcacatcatgggcggcaccatcatgggctccgatccgaagaactcggtcgtcgacggcgactgccgcacgcacgatcacgcgaacctgtggttgccgggcggcggcgcgatgccgtcggcgtccgtcgtcaatacgacgctgtcgatggcggccctcggcctgaaggctgcggattcgatttccgcgagcctcgcgaagggttgattcgatgacacacacgatccaacgacaacttcgcacgctgcgcggcgccggctaccgcgcggccatcgcgctcgcgctgttcggcagcgtcggcagcacgcccgcgttcgcgcaggaaacagcgaccggcgcggcgtcgacgtcggccgacgccgcgctgatcgaaaaaggccatcaactcgcgatcgcggcggactgcatggcgtgccatacggcgctcgacggcggcaagccgttcgcgggcgggtacggtatcgcgtcgccgatggggcagatctattcgagcaacatcacgccgtcgaaaacggccggcatcggcaactacaccgaggtgcagttcgcacgcgcgctgcgcggaggcgtgcgcgcggacggcgcgcgcctgtatccggccatgccgtatacgtcgtacagcggcctcagcgacaacgacgtgcacgcgctctacagctacttcatgcacgccgtgaagccggtcgacgagcccgcacccgcgacgaacctgccgttcccgttcggcatgcgcgtcgcgatgacgggctggaacatgctgttcctgtcggacaagcgtttcgaagccgatccggcgcacgacgcacagtggaatcgcggcgcgtacctgaccaatgtgctcgcgcactgcagtgcgtgccatacgccgcgcaatgcgctgatggccgaagacttcggccgcaacctgggcggtgcacagctcggcgcgtggtatgcgccgaacatcacgtcggatccggtgagcggcatcggcgcatggaccgacgacgagctggtgtcgtacctgaagaccggccgcgcacccggcaagaaccaagcggccggaccgatggcggaggccgtgcagaacagcctgcagtatctgtcggacgcggacctgaaatcgatcgtcacgtatctgcgcagcacgaagccgatccgcgacgagtacgagtccgaaccggcattcgcgcacggccgcgcggtcagcagcgaagcgacgttgcgcggcacgaccgcgttgaatgcgaacggtacgctgacgacgggtgaagcgctgttcagcggttactgcgcgagctgtcaccaggccaacggcaagggcagcccgagtcaagcctatccgtcgctgtcgaacaataccgccacgggctcgcgcaatccgtcgaacctgatcgcggcgatcctgtacggtgtcgatcgcgacgcgggcggccagcacgtgctgatgccgtcgttcggtgaggattcctacgtccagccgttgaaggacgatcaggtcgccgcgatcgcgaactacgtgctcgcgcagtacggcaacgcgaacgtgaccgtgacgcccgacgacgtggccgtcgcgcgcaacggcggcccggttccgctgctcgtgcgggcccggccgctgatgctcgcggcgccggcggttgtcgtgctgctcggtgtcttcgcattcgtgctccgccgacgacgggcacgtcgtacggtacgctcggcgatgacgtccggtgaggtcggatgattgaggatgtcaggcatgccgttgccggactcgcggtcttctgactttcggaagagacgttggtcgttcagccaacggacatggatgcaggcgaggcgctcgcgcgaagtacggcgctcgcgttctcgccgccatccgatacatgcaggcagtatctgccgatgcacgatgcgccacgcgtgtggattcaggttgtggaccgcggtgattgctggccggaaccacgtcgactcacatgccatcgccgcaagacgtgcatgcatatcggtcgttgccacgcagatccctaaaaggagggggtcgacgggtttattttgatcccactcccgcaggattctccatgaagtgcgcgtccgcattgaatccgccgccgataccggatgcacaccgtctgccggtcaacgcagccgcagccgccaccgataacctgcgggaccgtctcgaccccatcgagcactcacttcccttcgctgaacgcacgcgagacgttcagcaaatccgcgcccttgaccgccaaggcgcaccccacccagatacggcgctggccatctgcctgcaaggaccaccgaccggttcttccatgcatgggaaacgaatcggcgttacagccagaccgagtccggcgtgttcatcagcccggccagcttggtgagcacgaaacgcatatggtcctgcgtcgatgccatcacagcgacgcgaatccactgacgcccctgttcatcgcggttgaccgaaaaggtgtcgccgccggaaatcatcaactgatggcttcgtgccagcacggcaaagtgttctccgctcgaccagcgtgacggcaatttgagccagatgtggaacgaggtcggctgagccttgtactcaaattgcccgagcaattcgcgcaccatgatttgccgcgcgcgcttcctgacactggttgtgggccatttccgcggcttgcccgctcgtgatcagatgcgtcgcgatctgtgctgcaagggtgacaccatccagacgctcgttcgcacgcttgcggtcatgcgcgccagccactccggcgggcaatgcatgtagccgaggcgtatggtcgacgcaacggacttcgacaggctcgtcaaatagatcgtgcgctcgggggcgaaggtagcgagtggggaaccggcgtgggcgccagaaaaccgtacaggtcgtcgtcgagcaggagaaaatcaaaatcgcgcgcgatctgtgcgatctcgcgtcgccggttttccggcatcaccgccgtggtcgggttctggcaggtagcgatgcagatcaccagagcgggacgttcctcgcggcagatctcgcgcaggctttccggctccatgccctcctgatcctgacgcacgccgcgaatgcggcggcccagactcagcacgaccgaggccacgcccgggtaacagagcgactcgcagcacacgaggtcgccgggtttcgtgagcgcattgaccgccacccagagcccgtgttgagcaccggccgtgaggagaacctgttcggttcgggcgggaaaaccggagtgctgcatccacattgcccccgcctgtcggtgcaggggatgaccgccatcgggcgtgtaatcgagcatgtccggcaacgagctcgattgcgcaagttctccaagcgccgcgcggatatacggctcctgaagcagaaggttgggtttgacgatcgacagatcgatgattccgccggaggaatcctggacgggcggcaccgactggacacggctcgcagcgggcgtttcgcgacgtagcacgaaggtcccgcgcccgacttcgccctcgacgaggcctcgccgttgcgcgagttcgtacgcacgattgacggtgccaggcgtcacgccgatctgcgcggcgagttccttcagcgtcggcaaccgggcgcccgcggtcaggcggcccgcgtggatgtcgctctcgagcgccgctgcaatcctttcatagatcgccccggcatattccttcaggtccggtgcccacatggggacgactctccttgaatcggtgcaatgaatgtaaggtagcagtgtaatcgaatcatcattcgttgtcgaatcaacggatccagtgtgccttgttcctcgggcactcccgcccgcgcaccggatatcgcatcgaaatggttgactgattgagtcgacttaatcgagtgactttcagatgcaattaaatcgatgtatattaagtcgatcgattcgacaaagaggataggatgttcgacacggaaaaggatgccctgcagcacgtcgatcccgcgatctgggacgtgatttgccgggagaatcaaaggcaggaagaccacattgaactcattgcatcggagaattacacctctcctgcggtgctaaccgctgtgggttcgcaactcaccaacaagtacgccgagggctatcccggcaagcgctactacggtggctgcgaagtcatcgatgaagcggagcggctcgccatcgaccgtctgaaggccctgttcggcgcagaggcagccaatgtgcagccgcattcgggctcccaggccaatcaggccgtcttcttcgcggcgcttgagcccggcgacacgattctgggcatgagtctggccgaaggcggtcacctcacgcacggcatgccgctgaacatcagcggcaagtggttcaaggtggccagctacgggttgaacgaagcgggcgagatcgactacgacgcgatggaacgtcaggcgcgcgagatcaaaccgcgtctgatcatcgcgggcgcgtccgcctactctttgcgcatcgacttcgagcgcttcggacgcgtggcacgcgaggtcggcgcgctgttcatggtcgacatggctcactattccggcctgatcgcgggcggcgtgtacccgaatccggtgccgcacgccgacttcgtcacgaccaccacgcacaaagggctgcgcgggcgcgcggcggcgtcatcctgatgaaggaagaacacgagaagcgcatcaactcggcgatcttccccggcattcagggcggcccgcttgttcacgtgatcgcggcgaaagccgtcgcgttcaaattggccgccaccgatgaattcaaggcgtatcagcgccgtgtgctggaaaacgcgcaggccatggcggaggtgtttcagtcgcgtgggctgagcatcgtttccgggcgcaccgaaagccacatgatgctgatcgatcttcgctcgctcgagctgtcgggccgcgatgccgagcaggcgctgggcgaagtctgcatcacctgcaacaagaatgcggtgcccaacgacccgcgcaagccggccgtgacgagcggtatccgcgtcggcgcgccggccatcacgacgcggggctttggcctcgacgaatcgcggctggtcgccactctggtcgcggacatcgtgcttgcgccccatgacgccgacgtgcgcgcgagcacgctggaacaggtccgtgcgctgtgcaagcgcttccccgtctacaactgaggtcatcgtgattcgcacactgagtcaatggcgtgctgacgcctctctttccgcgctcgtggcgggctttctggccgtcctgatctcctacgctggcccgctcgtgatcgtgtttcaggccgcaaatcaggcgcatctttcgaccgaggtcacgtcgtcgtggatctgggcagtgtcgatcggcagcggaatttccgggctggtcctgagctggaaactgcgcacgccgatcatcacggcgtggtccactccggggccgcgctgctcgtcggcatgttgccgggcgtaccgttgccgcaggccatcggcgcgtatctgctgagcgcagccattgtgacgctggtgggcgtgtccggagtattcgaccgctttatcgagcgcattcccaagggcattgccgccgcgatgctggccgggattcttctgcacttcggcatgcaggtgtttgcttccatcagcgccagtccgctgctggtgttctccatgcttctcacctttctggcgatgaagcgggtctggccgcgctatgcgatcgccacggtgatggtggtcgggatcgtcatcgccatcgcgtcgggcaccacgcatctttcacaattgcgccttgcacccgttgcccccgtcttcatcgctccggcctggaactggcacgtgttgctgggcttgggcgtaccctggccctggtcacgctcacgggccaatacgtgccgggcatggccgtgctgcgcacgtcgggctatcgggttgcggcgagcggcattatcggcacgaccggcattttgtcactgctgctggcgccgtttggctcgcatggcgtgaacctcgcggccatcacggcggcaatctgcacgggcaaggaggcgcacgaggatcccgatcgccgttacatcgcgggtatcgccagcggcctgatctatatcggcatcggcgtattcggcggaaccctggcgctactgttccgcgcgttgcctgcggaactgatcgcggcgcttgcggggctggccttgatcggtgcaatcacgactggcgtgatcggcgtggcacaggacgacaagcatcgtgatgccagcatcatcacgttcctcgtcacggcgtcgggcatgagctttcttggcctgggttcggcgttctggggctcgccatcggcgcgcttgcctatgccatcctgcatcgaagctggcgactgcgcgacggcaaggcgccggccatgaacaagatttgatcgagacagaagacggaaaaggcacccgccccgctggggacttattcccaaggcgtgcgcgttggcaatacggtctatcttgcggcccagacgccggtcgtgccggaaacgaacgaagtcgcagaaggcggcttcgaagggcagcttcaccagaccttcaggaatcttcgcgcaatggcgcaagcttgcgactgcacactcgcgaatgttgtgcaggtcacggtgtacatcacggatatttcgaaattcgggacgatgaactcgatcatggccgaatacttccctcagccttacccggcccgcacgacggttggcgcggcgagccttgcacgcggcacgatggtggccatcgacgccatcctggccctccccgactgagcccctaggcagagcatcgcttacgaaagccgatggcggcgccaccggctttgacacgtttcggacaggcgtaaaaacggggatgacaatgagttttggattttcgacggcgctgagatgtttgaattgcgatgccgagtacccgctggaaagcgttggctactttgcccacagtgcaagctggacggcgcgctcgatgtcgaatacgactatggcgctgcggcgccggtgtttgcgaaagcgctgggcgaaaagacccgcgcattcgatatgtggcgctaccgcactctgttgccggcgggtttggagcatgccccgaagccacataccggggtacgccgttctatcagttgccgatgcgcggcgacggcctggtcttcatcaaggacgacagccgtaatcccagcgggtcgctgaaggaccgtgcaagcgcgttggccgtggcgctcgcgcgtcaccagggcgtgggcaccatcgctgcggcgagcacaggcaacgcggcggctgcactggcctgcatgaccgcgggcagcgatctgcgttgcgtgatcttcgccccgaccagcactgcacgcgaaaaactcgtgcaaatcagggcgtatggtgcagacgtcgtgcaggtcagcggcggctatgacgaagcgttcgccgcgtgcctcgaagcgtgcgagaagcacggttggtacaaccgtagcacgggcatcaattcgtatatgaccgagggcaagaagaccgtcgcattcgaaattttcgagcaactgggctgggccgtgcctgaccgcatctttgtccccgtgggtaacggttgtatcgtgggcgcggtctacaagggcttcgaggaactccggcgcatggggctgaccgggcacatgccacagatcatgggtgcgcaggccgaaggcagcgactacatgtatcgcgcctgggtacaaggcgagggaccgcatcatgcggaacgcaaaatggcgaagacctcggccagcagcatcagcgtggtgttgccgcgcgaccggatcaaggcctttcgcgccatcgaggcgacaggcggccagttcgtccgcgtgagcgacgccgaaatcttccagcggcaaatcgagttggcgcgcgagtcgggtgtattcgcagagccgggcgcggtcgcggcttacgctgcggcgcaaaagtttggctccgcgcaacgagacgaaaccaccgtcattttgattacgggcagcgggctgaaagatgtaggcggcctgctcagcagcggagtgctcgatcacgcacgattgagcgaagctgcctgacgcgtgtgtgacccgttatggtatgagtctgggtacgcgggcgtgtgccagcccgcgtgatcacgtcgagaaaccggtcggttcagatgcgtaagtcgagaccggatctctcagtcagcgtcagatcaggtctgagattgcttcgctctcgtcaagggccctgatcgacccgtctcggtcgtacgacgccggtgcccgtcgacggccgctttcgaagtacagaagccgttcgacggaaggatcacggaaagcagactaaacggcttgttgttggcgtaggaactccagcaccatccggttgaatcgctctgcgtgctcccattgcgcccagtgcccgcagcgcccgaacacatgcagatcggcgttcggcataccccaaacgagccgcaggccgacgtccatcggcacgaaacggtcgtcgcgcccccagatcacgagcgcgggcgacttgatctcgttcaaccggtaaccatagtccggaaactgcttcggattggccgccagactcttcacgaagttctcgagatgatcgcgccgcgccagcatattatcgagccgcgtctgcatcagttcttcggtcatcgtgctcgcatcgtagacgaacacgttgagcatcttcttcaggttctcgagcgttgggttgcgatacagcccttgcagcagcttgatgccttcggtcggcatcggaacaaactggctcggaccgcccgtgccgccgcccatcagcaccagcttgccgacgcgctccggatacgacagcgcgaatgccaccgcgctatgcccgcccatcgagttgccgacgagatgcgcgctcgatgccgagcgtatccagcacgcccttcagcacgcgcgcgttgaggtctgagcgcgagccggtacagatgatcgaatcgctcttgccccagccgggacagtcgacgaggatcacgcgataacccgcgttcgcgaacgcgtccacattgcgatggaagttcgcccagccgctcgcgcccggaccagagccgtgcagcagaacgagcgtttccttgcccgcgccggtgtcgttgtagtgcacgcgcagttccgtgccgccttccaccacgttcacgtacttgctggtcgcagcttcgctatgagtcacagtgtcagtcatgtcgagatccttcgtcagatcgattcggttccaagtgtgtgcgagccgttggccgactcgcgcggaaatttcccgaccaccgcgagcgcgccgagcgcagcgatcacgatgagcggaatgctggagatcacgagcatcgacgcgctctggccgagcgcaaacagttgcccggcgatcagcgggcctaccatcgagccgacgcggccgacggccaccgccgcgccgacgcccgtgcctcgaacccgcgtcggatacgttgcaccggcgagcgcgtacagcactgactgcgtgccgacgagaaacaggcccgccagcaggcccccaatgccatcgacgtgctgccgttcgcgctggcgagcgcaagcaacgcagtcgcgatgcccgtatacatgccgaccacgaccacccgcttgccgatgcgatccatcaggccggcgatcacgatcgcaccgacgccgccgccgatgttgaacatcatctgcacgatgcttgcctgtaccggcgtgaggccgcgcgagagcaccatcgacggcaaccagttcatcaagaagtacagcacgatcagcgtccccaaatagctgatccacaacgcgatggtcgtaaccgcacgcccgtcactgaagagcgcgcgcgcgatgccgtccttcgactcatgggtcgcaccccggccagccgcgacgaagtgcgtcgactccttgatgaaaagcgccagcagcggcaaggtcagcagcggcccgatcccgccgacatagaagatatgccgccaggcctcgacgctcgggctgacgatgccgattaccgctgcgagcgccgctccgaaaggcatgccgcagtacatcgcgccgaccgccgtgctgcgttgtccgggcgctgccgcctccgcacacagcgcgatcaggttcggcatcgcagcgccgagaccgaggcccgtgagaaagcgcgcgacgagcaggctttgcagatcccacacctgggtcgttgcaatcgaaaatatcccgaacagcgcgaccgacatcatcagcacgcgcttgcggccgatgcgatccgcgagcctgccgccaatcgccgcgcccggcagcaggccgagcgcgccgatgccgaatgcccagccgagctgcgcggcagcgagatgaaactcgcgtgccatgcgcggtgcggcgatgccggtggattgcagatcgagcccttcgaggagtgcgactgcgaagcacaggccgatggtgatggcgccgccggcgcgcgggggaagccgttgacgttttcattgatgtctccaggttgaacgatgcagcgctcttcatggcgcgtggcataccgaatggttcaggcgcgtacttcacgcttcttcagatcgagcgcgacgtcgacgatcatgtcttcctggccgcccaccatgcgtcgcttgccgagctcgacgagaatgtcgacggctttcaggccgtacttcttcgccgcgatttcggcatgccgcaggaagctcgaatacacgcccgcataaccaagcgcgagcgtttcgcggtccacgcgcaccggccggtcctgcaacgggcgcacgatatcgtcggccgcatcgagcaggcgatagagatcggtgccgtgatgccagccaaggcgctcggccgccgcgatgaacacttcgagcggggcattgcccgcgcccgcccccatgcccgccagactcgcatcgatgcggtcgcagccctcctcgaccgcaacgatcgagttggccacgccgaggctcaggttgtgatgggcatgcatgcccgtgtgagtctcgggacgaagcacggccttgagcgccttgaagcgcacacgaatgtcgtgcatgttcatcgcgccgcccgaatcgaccacgtacacgcaagtcgcaccatagctttccatcttcctcgcctcgatagcgaggtggtcaggcgtggtcatgtggctcatcatcagaaagccgacggtgtccatgccgaggctgcgcgcatactcgatgtgctgcttcgaaatgtccgcttccgtgcaatgggtcgcgacacgtacgacacgcgcgcccgcgtcgtacgcggccttcaggtcgtgaatcgtgccgatgccgggcagcagcagtgtcgcgatttgcgcgtgcttcaccacatcggcgaccgcctcgatccattccagatcactgtgcgcgccgaagccgtagttgaagctcgaaccctgcaggccgtcaccgtgtgcgacctcgatgctgtcgaccttcgcctcgtctagcgcgcgggcaatgtcctgcacgttctgaatcgaatactgatgacggatcgcgtgcatgccgtcgcgcagcgtcacatcggagatatagagtttcttgtccatgatcgagtgctccctgcttcaggcgttcacaaccgacgccgccatgcgttcggccgttgccagcgcggcggaagtcatgatgtcgagattgcccgcgtaggccggcagataatgggccgcgccttccacttcgatgaagatcgaggtcttcagtccgctgaaatggccgagtccgggaatatgcaacggcgcagcggcggggatctcgtcgaactgcacggattgcttcaggcgatagccgggtacgtaggcctggaccgcagcggccatccggctaacggacgcttcgatctgcgcccggtctgccgcttcggacagcacatagaccgtatcgcgcatcatgagcgggggctcggccgggttgagcacgatgatcgccttgcccttgccggcgtcgccgaccgcttcgatcgccttcgacgttgtctccgtgaattcgtcgatgttggcgcgcgtgccgggccccgccgacttgctgctgatcgatgcgacgatctccgcgtaatgcacctttgcgacccgcgacacggcggcgaccatcgggatcgtcgcctgtccgccgcacgtgaccatgttcacgttcggcgcatcgagatgcgcgtcgaggttcaccaccggcacacaatacgggccgatggcagcgggcgtcaggtcgatcacgcgaatgccgggcttgagcgtgcgcaggaacgcgtcgttcttcacatgcgcgccggcggacgtcgcgtcgaacacgaagtcgatctcgtcgaatacgggcaggcgcgccagcccttccacgccttcatgcgtcgtcgccacgccgagcctcgcggcgcgcgcgaggccgtccgaggccggatcgatgccaaccatcgccgcgacgtcgagatgcttgccgcgacgcatgatcttgatcatcaggtcggtgccgatgttgccggatccgatgatcgcggctttgcacctggtgttgtctgttgccatggaaatgtctccgtccgtcattcgctgaaactggcgcgcacaccgccgagcccttcgatgtgtgccgtataagtgccggccgccttcaccacgaccatcgggccaagcgcgcccgtcagcacgatgtcgcccgcgcgcagcggcgtgccgagtcgaaccatcctgtccgcgagccacacagccgcattcagtggattgccgaggcacgcacttccattgccgcgtgaaagcacttcaccgtcctgcgtgagcgtcatcgcgcaagcggtcagatcgatatcgcgcagcaggaccgggcggctgccgagcacgaacaacgcgctcgacgcgttgtccgcgacggtgtcgaaaaaccggatatcccagtcgcggatgcgactgtcgacgacctcgatcgcggcgaccgcatacgcggtcgccgagatcagatccgcgaaggtgtgcttttcggcggtcaggtcgcgttcgagcacgagtgcgatctccgcttcgaccttcggttgaatcaacgaggcgagcggcatcggctggctgtcgccgtaagccatcgacgcgaacaacgcgccgaagtcgggctgatcgacgccgagctgcttctgcaccgcgggcgaagtcaggccgatcttcctgccgacgacgcgctcgccgttcgctgcgcgcaagtcgttgttgatctgctggatcgcgtaagcgagtgtcgcgtcgccttcgggacacgtctcgcgcagtggcgcgatcgtccgacgcaaggactgcgcctcacgcaggcgcgcggccatcgaaagaatgttgctgtcatccgacatggttctatctcctggaaagagtccgttctcgcgcgtgcatcgcgccgaagcccgcgatccattccggaatcgcgcggtagtaatcgatcgatgcctcgtaacgaccgctcgccgcaagcgcgccgaatgcggcgacccacgtgcggatttcgtgtgcggacttgcctgcctcacgcgtgattgcttcgttcgtgaagccatcggcggcggtgagttcaccgcgttcgagcagttcgagaaatgtggtcccatgcgggattgagcggatgcagccggctgtcacccgacgcgaatgccttggccgccgcgacggtacgcaactgccgcgcatcgcgcgactccggtgacgggttgcgtcccgcgatcaaccgttccgcgacgacatcgtccgcgcccgcgatttccggcaccggcggctcatgcgaaatgccgcccgagccgatcagcaacacgcgcttcggcatgcgcgcgacggcacggccaatcgcatcgccgagcagccgggcgcggcggcacgacgccatcggcggcgcgaccgagttgatgaacacgggcaccactggatagcggtcgatgccaccggtgagtacctcgagcgcctgcgcgcaaccgtgatcgacctgcatgcgatacgacacggcgacgtcgatatcgctcgcgagtgtggcatcagcgagcgcgagcgccacatcgcgcgcgacgggcaacgggccggccgcgctgccgaaatcgccgatggccgtcgcgctcacgccgatgcagaactgcggcatcacgtcgtagaaaaatccgttgtagtggtccggcgcgaacacgattaccagctccggatcgaacgcatcgacccgttcgcgcgccgcgcgctgcaccagttcgacttccgcgacgacttccggactggggtcgaaatacccgtgcaagggcgtgtgcgacatgcattcgagatgaatcggcatctcaggcccctaccaggtcggcggcgtgcgcgaacgtcgcgccgttggccgtcgcgcccgttgccatcacaagcgacagccgttgcgcaagctgcgacacacaacccgatacacattgcggcgagcacatgccggccacgaagcggtcgggccgcaacagcacgaccgattcgggcatgcgcgcgaaccagtcgcgcaagcgcgagtcgacatcgccaaaggcgatcacgtcgtcaggcacgtcatcgtggaaggcgagctgcggatcgggcttcacgatcacgaagcacccccaagcgcgttccagatacggcgcgcctcgggcgtcaggccgaaagtcgggtccgtgccccaccccacgatcgcgaaacggttgccgatcgcatcgtcgagccggacgatgctgccatccaccagacgcacgcgtggctggatgaacatacggcccacaggagtgcccgcctgcgcatcgcggccgtgcaccatccgcccgatcagcgattcacgtttctcgctcatcaaaccgaccagcctgccgaacgcgccgtgtccgcgcttcgcgatcatgcgcgcgagcagcccttcggaccgcgcacgtcgcgccagaagcacgacgccctcttcatagcgcggcatcggcttgaagcgcatttcgacgaagtaacgcttcagggaaggcagcatgtcgaaaccgcgcacgaacgcgtcgcgcactttcgatccgaagaagctcgtcggcgcgaagatatcgcccgcgacttccgagaggtggatcatcgaacgcgcgtgggcgcgccgctccatcgtgtaggtatcgagcagcgcgtcgtgcgccgtgcctttcacgaccatcgcgagcttccagccgagattgctcgcgtcgcgaatgccgctgttgtagccctgcccctgccacaccggcatgatgtgcgcggcgtccccgcgagcaggatgcgcttgacgcggaaggtgctcgcgagccgcgcgttgtgcgtatagacccgctgacgaatgtagtcgaccttgtcgggatcgtcgaccaccccgcgcaccaacgccgccatgttctccggcttcgacagttcctcctccgtctcgcccggcatcaccatgaactcgaagcgccggatgccgtgcggcagcgccgccgacacgtagggccgccgcgcgtcgcaatgcagatagacatgcggagagccgatcggatcgttgcgcacgtcgatcacgatccattgattcggcttcgtgcggccttcgaacggcacgtcgagcgcgcggcgcacaaagctgttgccgccgtccgcgccgaccatgtacgcggcgcgaatcgtcgtcttcgcaccgttcgcgtctgtcgcctccatggtcacaccgcactcgtcctgcgcgaagctgtcgacgctgtggccaagcagcgtcgatacattctcgaaacgcccgagccccctgtacagaatctgatcggcgagcggctggatgaatgcattgcggcgtggccagccgaactcgtcggtgcgcggctcgatcgacgcgaagcacttccctttcagcgtgaagcgcatccagtgattcggtgtggtatgcggcagcagagtgtcgacaagaccgaccgactggaatacgcgcagtgcttcgtcgtcgaggccgatggcgcgcggatagtcgatgatctgcgcgagcttctcgatcacgacgacgcgcacgccctgcaggccgagaatgttcgcgatcatcaggccgaccgggcccgcgccgatgatggcgacatctgcgtcgatcgaacgatgtgtcgtttcgtgaggatgagtgcggccgttgccggccgccggttcagggcggggcgcatgtgtgtctcctgactgggcttgtccgatgcgctgaaccgacgaagcgcctggctctcgatcgttcagcttatgaacgcagtttatggatggcggaaaacccctcaacaaaatctccggaatgtgcatagaatgcacatgattgatttcaatggaatttttccgtgacaacctatacgaacgtgcgcggactggcgcgcggcctccaggtactgcgggctctgaatgcgatggaagacggacgcgcaacgagtcagcagatcgccgatctgaccggcctgcatcgcaccacggtgcgccgcctgctcgaaacgttgatggaggaagggttcgtacgccgcagcacatcggacgacagcttccgcctgacgctcgccgtgcgttcgttgagcgagggcttcaccgataccgagcgtatcgcgaccgttgcgccgccgatcatgggccagctcctgcagcgcgttgcatggccatccgatctgaccacgcccgatggcgatgcgatgatcatccgcgagacgacgcatcgcttcagccggctgtcgtttcatcgcgcgatggtcgggcggcgtttgccgatcttgctgacggctgcgggccgcgcctatttcgcgatgtgccccgacgaggagcgcgaggacattctggaactgctgcgctccggcgcgggcggcgaagagcaacaggcgttcgcgagaaacgacgcgctcgtgcgcaagctgatccggcgtgtgcgagaggatggtttcggctcgaatcacggcgactggaccgcgcaggcgaaaatcggtgcggtggcggtcgcgatcagcgcggacgaacgcgtgatcgccagtctcaatgtcgtcttcctgtcgcgcgcggtcagtctcgaagatgccactcgccgctatgtgcccgagctgcaaaaagcagcattggatattgccgaagcattgaggcaggaaccagcaactcgtccccgtgcatcaacgtaggcacctggaccggccgaatgtcgtgaacgggagccgaacggtcacgcggatgactatgtgccgaccgcgccggacggccgagaatggctgaactgagtcagacgatctgacgctgactgacagatcaggtctcgatttacgcaaagagttgcggttcgaacacagcgtgttcacccgtcacgagattggtccgccgtctgtacgacaagttcggcgccagtttcgcccaccggatcatgcccaaccggcactgccccgggcacaacctggcgcctcgggaaatcttcgtgacgttgcgcggcgcccctattggatgcggcgcgccgtcgacgaacactgtgccctgcttcggaagcggtgtgacaaggccgcggcccaatgcttcttcgagcgagtgctccgcaccggacaagatcgtcaccgatccggaactcgcaagaatgagcatgttttcgtcagaacggctgcgcgcatgaacaaccgtgccgagaacagtcatcagccaaagcgcgaactcaagcgacgcatgcgcggctttcgactaccggagcggacgcaggcattcctgccgtgcttcgctccgattcgccaacacttcgcgttcagtcgtcatttgccgcgggcttcacgccaccgcaagcaacttcgcgatgcgattcgaaacctggcgccttttcaccggcattaccccaaatccgtgcggcgacgcctgcatggcagcttcaacagtgtggcgttgtcctgccaacgccaacgcggcaaagctcattgcactcccccgccaaaccaaaaacaaagccggccccaagccggcttcgtcatgccctcgagcaacaacacgcccccgtcacttcatgcaagccgaagcgagcttccccaccgcaatcaccgcctgctcgatctccggcgaccacgggctgctgtagttcagccggatgaagttccggtagttgtccgtgatcgagaacatgtagccgggcccgatcgtgatgccctgctccagcgcgagctggtacagccgcatcgcatcgacctgcgcgggcaattcgacccacagcacatacccccgccgggctcgagatgcgcgtgccctccgggaaaaaccgcgacaccatcgcccgcatcaggttcgcctgctgcgcatacgccttgcgcaagcgccgcaggtgatgctcgtaaccgtcgcgttcgagaaactccgcgatcgcgagctgcggcaacgacggcgtcgcgagcgtgttcaggaatttcagcttctcgacctgatcgcgataacggcccggcagcgcccagccgatccggtacgcggccgtcaggctcttcgagaacgatgagcaatgcagcacgatcccgttgcggtcataggacttcaacgaactcggatgcgcatcgccgaaatacagttcgttatacacaccgttctcgatcagcggcattccggccttcgtcgcgaactcgaccagttcgcgcttgcgctcgtcgggcatctggaagccgagcgggttctggaagttcggcatcaccatgcatgcggcgatcggctgcgacttcgcgatcgcggccagcgcggcgatgtcgatcccgtattccggatgcgtcgccacctcgatcgccttcatccccatccgctcgatcgcgtgcagcatcgcgtagaacgtcggcgattccaccgcgatcgtgtcgcccggtttcgccaccgcctgcaggcacaggttgatcgcctccgtcgcgcccaccgtcacgatgatctcgttcgggtccaccgacatcccgttttccaggtagcgccgcgcaatctgccggatcagccgcggatgcccgggcggcaatccgtccgtcacgccccacagcgacttgtcgcggccggccgcatacgcgtagcggttcagcttctcgaacgggaacaggctcgggtccgggtacggcgagccgagcggcactgcgtcgtcggtgccgatcgagcgcagcgtcgacagcacgagccggctcacgtcgaccgacgacgagatcgcgatcggcttcgacggccgcagctcgcgcaccggcgcatggccgtcgtcgcgccgcaggttcacgaaatagccggactgcgggcggctttcgagcagcccgcggctttccagcagcagatacgcgtgcagcacggtcgtgatgctgatccggtgctgctggcttgcctgccgcaccgacggaatccggtcgccgtgccggtacacgccctggcggatcaggcgctcgatgtcgtccgcgagcttttcatagagtttcatcgcgtgcctcccgccggcctgcgcagccgccccgcccgctgcgcgcatccgatacgcacgtgttccgcccgtcgaccgggccatcgtggttcctgatctttccctccggttttgccttttccatcgcactggctcgctcttgaagatgcgccaacagggttccggtacgactggatctgcggcactgtgcccttgatgatggaatcttaagagcagaacagttggcgacgagtacacacatcgtccacgcgaacaagagtacagttcggcgcgaatcgcgcatcgcgggagaactgtacgtcttatgaaatggccgggccgccggaagcggcacacagcgtggccggatcggcccggaacgcccgccgcacggccttccgcccggctgcatcaattggggtgcaatactgtgcgtccgctcggttttcattcccggagtcagaccatgcagtacacgatcgaacaggcatccgacctcggcggcctgatccgcaccgcccggaacgtacagaattggcgcaggaacgacgcggccggcaccgaggcccgcggatgactgatcgcgccctcgtcgacgagctcgtcgcgcggctgaccggccgcaccgaccatccgcacttcaccggcgcgccgatcgacctgtcgacgctcgacgcgcacgcgctcggcgcggtctggccggccctgcgccgtgtcgagtacgagatcatggtgcacgacgaggcattcgaggatccgcgcgccgatttcgcgcgctggctgcaccggcagatcgatgcgctcggactcgtgccgctcgtcgacgccgatgccgcgctcgaactgttccgcgacatcccggccggcggctggaaacgtgcactggaggaattgccctgcctcgacgcgctgccgtcgcctgcgctgcaggccgaactcgcgcgcatcgcgggcgagccggaggaaggcgacgagcgcaccgcgtccagcacgtatggcgtgtatacgctcgaccggttcgccggccgccgcgacttctcggcgcgacgcgacgcgtatgcgcgggcgctggcggattcgccgtttcgcgtgcgcgaactcgacgtgctgcccgaactcgggctggccgggctgctcgtgctggccgcgacgaacaacggctatttcgcgccgaggcggttgtggctcgacttgagcgatccggccgtcacgctcgcggaagacgccgcgtatgtcgcgttcgcgcgcgatgcgctgacggaagccgcgcaacacgtggcggcgctccatgcgggcgccgtcccatacgaggccgatcgtgcattcacgaccgacgacgcgcaggtcgtcgcccgggccgcccgcgtggccgcctatcgcgacgaagcgtggctgcgcccgctgatcgggccgctgctgaccggcgtgtgcgtcgcgccgacggccgcgaagaccgcgccgtcccagtcgctcgcgatcgcgctcggccacgcggtcgagacgatcccgaccccggagggcgtgcgcgcgctgcgcgacgcactcgccaccgtgcgtcacgccggcgtgcagaagaagctggcacgcaacctgaagccggccgagcgcgcgctcggcgagcggccgcacaccgcgctgcgcatgacgctcgacgcaaagcccgacaagaagcagctcgcgatgctcgcgacctgcatggaagccggcttctggcagtcgatgacgctcggccacgccgaatggcgcgaacgcctcgtcgatgcgccggccggcgccgcgttcgcggcacgcacgatctggcacgcgcgcggccgcgatgggtcgacgcagtcgttcatgcccgagatcgcaaagggcaaggtcgtgctgcgcgacgcggccgggcacgcgatcgacatcgccggcgacagcgacatccggttatggcacccgctgctggccgacgcggacgaacggctcgcgtggcaacgcgcgatcgtcggccgcacgctgcggcagccggtcaggcaggccttccgcgaatactacgtaccggccgacggcgacgcgtccgccagcgattccgcaatgttcgaaggccacgtgctgtcgagccggcagctggtcggcgtcgcgcgtcgcgaaggctggtcgatccgcgcgtacgacgacgggctcgtccgcgaattcggcgacgtgcgcgcgaccttcttcgtcgatgcgcggctctatccgggctcggaaagccacggcacgtcgcgccggctgcacttcgaacgtcggcacgaccggtgctgggtaccgctgccgatcggcgaaatcgatcgtgtggtgttctcggaagtggcgcgcgcggtcgatctgctcgtcagcgtcgccgcgttcgcgctcgacgacgatgcaacacgcgcggcgacggccgcgctcacggtcgatccggtgcgccaacgcgagctcgaagcacaacgctggcagcgcctgaaccggttgtcggacgtgccgctgggcacgatggcgcggcatcgccggcacgtgctgtcgctcgtgttcgccgggccggtggcgcaagggaagatgacgatcgatgaacggcatgtgcgcgtcggcgcgtggtcggtgcattgtgcgaccgggcgtgtgatgcgcgacggcgaacccgtcgatgccgcgatcgagccgccgccgtcgccgctgcgcgcggtgccgtggctgccttacgacgaagcgctgctgcagcggatcgtcgacgtcgtcgcggggttgctcgattgagcggccgccgtcagatcgaaccgaacagcgcgcgcggccggtccttcagcgtgccggcgagaatccgcagcccgttgacgagttcgtcgcgcgaggccgggcacgcgaggttgatgcgcacgccgtgctcgatctccgcgcgatcgaccgcgaacgtcgacgacggcatcacgatcacgccgcgcgccttcgcgttcgcggcgaagtcgtcggcgcgccacggcggcggcaggcgcaaccacacgaacatgcacgccggatcggatttcagctgcccggccggcagcagctcccgcgcgagatcgacgcgcgcgcggatctccgcgagttgcgcgcccatgatccgctcggcggtgccgtcctcgatccacacggtcgcgatcagcatcgacgtgggggccggcatccatgcggtcgtgcgcaccgcctccgcgcacagtgcgacgctatcgcgcgggcagctcaggtaaccgaggcgcagccccggcgcgaggatcttcgacgtcgcgccgatatgaaacgtcagctcggggcacagccccgcgatcgccggcagccggtcgcgcacgagcgggccgtacacgtcgtcctcgatgatcgtcacgtgatggcggcgcgcgatgtcgacgagcgccatccggcgcgcgaggctcatcgtcgtgacggtcgggttctgcaggttcggcacgacgaagatcgccttgaccggcatgcgctggcagatccgctcgatctcgtcgggcagcaggccgtcgtcgtcggcgggcgcgctgacgatctcgaactggaacaccggcgcgagcgccttgagcccgtaatacgtgaggcggtcggccacgatcacgccgtcggtgccgatcaggctgttcagcaccgcgtacagcccgtgctgcgcgccgctcgtgacgaccacctggtcgcgcgacggcgcgaagcccggcgcggcgagccactgcgcgccggcggcgcgcgcccagtcggggccctgcggcggctggtattcctggagggcggcgaaacgcgggtcgttcggcagcgtgccgaacgtctgcgcgaggctcgcgagaaactcgccggtggccgggcggttcaccgtcaggtcgatcacgccgttgcccgccgcgagcgacgcgcgggccggctcgatgctcggcatcgcaccgccggtgacgagcgagccgcgccgtttgctgccgatcacgaggccgcgcagctgcaattccttgtacgcacgggacacggtcgacacgttgatgccgagctcggtcgcgagctggcgctgcggcggcaggcggctgcccggcggatacatgccgctgcggatttcctcctcgatcgagctcgatacctcgacgtaggtcggccgcttcgcctgcgccggcgcgccgccgtcgcgctcgccggaaagtttgtctgatgccatttatcgcccgtgaccacacaaaaagcgtttgtctgccattttgacctgcccagcgattgtatccgacatcccctcccgtcaaacgtcagttgaaaagtctgtcgaatcagccagttggaatcgggtaaacactagcgccacacaatctcattttgattgcacacaaaaattactgtgtgattcttgatcgcaactttgtgtgaatcatgtggaccggagggaacgcgtcatggcgaatgtcgccatcgtgggtgcaggcttcatcgggctcggcgcggcggcatggctgcagcgcgacgggcatcgcgtgacgctgttcgacccggccggcatcggccagggcgcgtcgttcggcaatgccgcgacgttcgcgccgtacggctgcgtgccggtgaacggcccgtcggtgttccgcgacatgccgcacttcctgttcgccgccgacagcccgctgcgcatccgctggccgtacctgctgcacggcgcgccgtggctcgcgcggttcctgctcgcatcgacgcccgcgcgccacgcacgcagcgcgaccgcgctggccgcgctgctgtcgcgcgccgccgacggttatgcgccgctgcttgcaccgtcgcggctcgccgcgttcgtgcggccgcgcgaatgcctgtacctgtatgcgcggcaggcgtcgttcgacgccgcgcagccgtcgctcgcgctgcggcgccggctcggcgtgccgttcgagacgctcgacgcgagcgcgatccgccggctcgagcccgcactcgcgccgatcttcacgcgcggcgtgctgttcatcggaagctggcacttctccgatccatgcggattcctcggcgccctgttcgcgcacctcgccaccggcggcgccgcgctcgaacgcacgcgcgtcgaacggatcgagcccgccggcgacagcgtgaacgtgcatgcgggcggcgccatgcgcgcgttcgatcacgtcgtcattgccgccggcgcccgctcgcgcgcactcgcggccgcgtgcggcgacacggtgccgctcgataccgagcgcggctatcacgtgcaattcggcgcgcacgagccgatcgtctcgcggccggtcggctgggccgagcgcggcttctacatgacgccgctcgacgaagggctgcgcgcggccggcaccgtcgaactcggcggcttcgacgcgccgatgaatccgtcgctcgtcgcgctgctcacgcgttccgcgcgcgaagccgtgccgtcgctcggcgcaccgacgcgcagctggctcggcttccggccgacgctgccggacggcgtgcccgtgatcggccgcgcgcggcgcagcgcgcgcgtgatccatgcattcggccatcagcatctcggcgtgacgctcgccggcatcaccgggcaaatcgtcgccgacctcgtcgcccagcgcgcaccgccgctggacctcgcaccgtaccgggccgcgcgattctgacgcgcgccgcgactttcaccactgcaaggaggcatccatcatgaatcgtcgtaactggctggcttggctggccgtctgctcgatcggcacggtcggcgcatccgcgcaggccgcggacccggaaactgtcaagatcggcttcgccggcccgctgacggggcccgtcgcgcgcgtcggcaaggatctgcaatacggcgcgcaactcgcgctcgacgaagaaaacgcgaaacatccgaccgtgggcggcaagcccgtgcgcttcgtgctcgacgtgcaggacgaccaggccgatccgcgcatcgcgatccaggtcgcgcagaagctcgtcgacgacggcgtggtcggcgtgatcggccactacaactcgggctgcagcattcccgcgtcggccgtctacaagcaggcgaacgtcgcgatgatcacgcccggctcgaccaatccgcagctgacgatgcaaggcttcaagaacgtgttccgcacgatggggcacgacggcgtcggcggcgtggtggccggccatttcgcggtcgagcagctgaaggcgaaacggatcggcatcatcgacgatcgcaccgcgttcggccagggtctcgccgacgcgttcgagaagggcgtgaaggatgcgcacggcagcatcgtgtcgcgcgaatacacgaacgacaaggccgtcgatttccgcgcgatcctgacgacgatgaagagcaacaacgtcgacctgctgttcttcggcggcctcgacgaacagggcgcgatgctcgtcaagcagatgcgctcgctcggcatccgcgcgcagctgttcggcgccggcgcattgaaaagcaatgcattcctgaagattgccggcacctcgggcgaaggcacgcaggatctcgaaccggggccggcgctcgacaagctgccgtccgccgtcgcgttcgcgcagcgctacaaggcacgcttcaaccaggatgtcgagctctatgcgccgttctcgtacgacgcggcgctcgcgatgatcgcggcggtacgcaaggccgattcgctcgatcgcggcaagatcgtcgcgagcctgcccggcgtatcggtcaccggcgtgaccggaaagatctcgttcgacgagcgcggcgacctgatcaagccgccgtacacgctgttccgcgtcgaacaggggcagtggcacagcatccgcacggtcggcggcgcgtcgaactgacgcgcggcggcgcgaccgggaaccacaccgtcatcgcgccgcctgctgccgctgcacctcctgcgctttcatctgcagatacgcgccgcgctcgacctcgtgcagttgctgcggatactgctcggtcgcgtcgaaccagcgcgcgaggcgctggtcgagcggcttgtcgagcgtcgcgagatacgcatcgatcgcgaggtagtagcgcatcgtgttgcgctccagcagcccgcgcacaccgccgacgtactgcggctgcgcggccgatccgccgacgttcgtgaagccgaccttgtcgctgccgacggtcgcgaggtaggtcttcatcgccatgcggccgaccgtgccgaaaccatacgaatacgtgagatgcaggaacgtgcgcgacgcgccgaccggcacggcctccagcgcgatccggtaatccttcgtgcccatcgggccgctgtcggcggtcaggtcgacctggaaatagtcgggcgatgcggccgccacgcgatagcggaactgcacgcgataggtgtcggacagcttctgctggatcttgcggccgaggttcacgtcgagcaccgggccgttgccgccgcccgatgcatgacagtatttcgtgttcaggtgcaggatcagcaccgcgcaccagttcgcggggccctgcgcgggatcgtcgagctggccgctcacgaccgcgaacggatagtcgaccaccgcgtagatgtcgcccttcagcgacgacgacgcttccgtcgattcgagcaccagcggccggtgaaacgcgttgtccttcagttgcgcgccgaggctgcggtaacggtcgagcagcgccgccgcatcgtccgcgccgaacgacagcgcgctccagcccgtacacagggccgcgacgagcgcgtaccaggcgcggcgggcgagccacgtgccgcgcggatgtccggatgtcttcattcttgtgctcccgcctggcgcgcgatggtcgcgcgcatgtgtcacagaatacgcctggccgcagcgcaacattgcacgcgaaaaggccgttatcgacgccgcttcaccggcaccggcaactgcgcggcggtgatccggatcagcgccgacagccattcgcgatcgtcccagcgctcgcccgagatgacgaggtgcggcttcgcgcccgggtacggcgaaccttcctcgcacgtgccgagaaacgcgcggccttcgggcgtcggcttgacgaacagccgatcgtcgcagacgagcgccgccatcttgccgtcgcaatagataccgtactcgccgaacatcttgcgcgccgacaccgtgccggccgccgccatctgctcgacgatgaaatcgactgtcccctggctcgatgccatccctgctccttgcaaaggtgtatgaccgctgcgtgtgcccgaccgttccgcctgatcggcggatgcgctgcggtgcgtcatccattcgtcggcggaacgcgcattcggacgcattcgagcacgtgcaggcattcgcggcccgcaacacgctgcgtgtcgtgtcgtgacggtcacatgacggcgcgcggccgagcgagacgaccgcgatcgacgacgtaacaatgcgacaacgcccgcctacgaacgcaataccgacggcgcgacgcccagccagcgatgaaagctgcgccgcatgttttcggtatcgccgaaaccgcactcgttcgccacgcgctgcagcgacgccgccccgctttcgagcgccgcgcgcgcgcttccacgcgcagtttctcgacggccttggccggcgtgaggccggtttccgtctggaacgcccgcgcgaactggcgcgggctcatgcacgcctgctcggccaggtcgctcacgcgcaagcgcgcgccgagattgcggcgaatgtggtcgagcaacggcttgaagcgcccttgcgcgctgtcgagttcgatcagcgccgagaactgcgactgtccgccggggcgccggtagtacacgaccagacgtttcgcgacggcgcgcgccagccgctcgccgcgatcctcgccgatcaacgcgagcgtcaggtcgatgccggccgtgatgccggcactcgtccagaacggcccgtcgttcacatagatgcggtcgagcgcgagccgcacctgcggaaacgcccgggcaaaccgctcgccgcagccccagtgcgtggtcgccagccggccgtccagcacaccagcggcggccagcagcaggctgcccgaacagacactcgccacccggatgccgcgtgccgcgcagcgccgcacgaacgcgcacgtcgctgcgtcggccatcgcggcgtcgacgccgtcgccgcccgcgaccagcaacgtatcgaggtccgccgcatccggcaaaggctcggcgtgccagctcacgcccgacgaactgcgcaccagccccggctgcgccgcgacgatgcgaaccgcgtaatacggcgcgcgcgcgtagtcggccatctcgaacgcggaaacgggcccggcggcatccagcacctggaaaccgggatacacgagcatggcgacgcgatgggtcatggcagaaagtgcgggagaaatgacattgcgacggacagcgcgcggcgcgatgctacacgccgctcatacctcgggagatcgtgatggccaccacgccgttcatcgtcgtattcgcattgttcgatcatgtcacgcagctcgatttcaccgggccggacgaagtgttctggcgtctgccgggcgcgcggatccggcgagcctcggtgcgcggcggatcgattcgcgcggacagcggcctgaccgttgccgaggtcgagcggctctccgacatcgcgcacgccgatctcgtctgcgtgccgggcgggctcggcgtgatcgacgcgatcgcggacgatgcattcgtccgcgaggtgcgccggctcgcgctcggtgcccgctatgttacctccgtgtgcagcgggtcgctggtgctcggcgcggccgggttgctgcaaggccggcgggccgcctgccactgggcgtggcgcgacctgctgctgccgttcggcgcgatcgtcgacgaaggccgcgtggtgcgcgacggcccggtcgtcacgggcggcggcgtcaccgccggcatcgacatggcgctctcggtgatggccgacctggccggcccggcctacgcgcaagcggtgcagctcggcatcgaatatgcgcccgagccgccgttcgactgcggacgtcccgagcaggccgcgccggacattctcgcgtcggtgtccgcgctgttcgagcgcgtgcggcccgatcgtcatgcggtcgtggcgcgtgcggcgcagcacctcgcgcagcccgacgcgggccgacaaccggcatgacgcgcgcacggcccctgcaggatcgacgcgacgccgttacttgtctgccgcaaacgcgctcgacatctgccgtgcccgcttcacgtcgtcgccgtgcaggtagatcgacgtcgtcgagatcgacgcatgccgcaggttgtcgcgcacggtcgtcagctccgcgccgcgcgccaacgcatgcgtcgcatgcgtatgacgcatccagtgcgggctcgcctgccgcagcttctgcgcgagcgcggggttgtcggcctcgacctgatcggccgtctgcgtgaagaaacgctgcatcaccttccacagccgcacgctcgtgatcgcggccgcgccgtcttccgcgaggctcgcgatcagcggcgtatcgggccgccagcgcaccggcgtgaccggcagccggcgtgcgaccaggtaacggtcgagcgccgtgcgcgcgagcggcggcagcgcgacgcgcgcggccttgccgcccttgccgaccaccttcagccacgtgtcgccgtgcgcatccgtctcgatgccgccgagcgtcgcgccgaccagctcgctcgcgcgcagcccggtcgcataaccgaaatcgagaatgaagcgcagccgttgcgcggcggccggcgtccagcccgactgcggcgcaccggccgccgtgccggtgcggaactcgagcccgtcggcgatcgtgcgcacgagcagccattcgccttcggtgaacgcgtgcgacgtgtcgagtgcgttcgcgccgcgcgtgtcgcgcaccttgacgcccgcgaacggattcgccagcaggtagcgctgctcgatcagccagcgaaacaacgcaccgagcaccgacagcgtgtacgccgccgaacgcgcggacagcgcgcccgagaacggccgccagtcgggcgcaccgcgcggccgcacgggcccgacccagcgttcgtgcgggctcgggcgccgcacgaatgcgcgatacgcgaccgcgtcctcggtcgtcagcgacgacagcgcgcggccgcgctcgacgatcgcccacaggatcagccgctccgcctccttccggtacgcacgccgcgtcgcggccgattcgtgcagcgacagccacgcgtgcacggccgcgtaatcgttgtccgcatcgagcgtgctggtcgcgcgcggcgctcgaaacgtgccggccgagccgtcgacctcgtgcggcagcttcaactgctcccacggcacgatgctgccgcgcggcgtcgccgcgatcagcgcgcgcgcccgttcggtcaggtccggatgcgcggcgaaaaacgcctcgatgtgccgcgcaccggccacgccgaggcccgcgatcgcacgccaccactggcgccggcgcggaatccgcaccgtgagatcggcgagcgtcgcgatcccgtgcgcccgcagcgcggcgactgcacgcgcgggcagccacaggccgacgtcgtcgctgatctgcgggaccggcgcgcgcgcatgacgcagcaggccgatcgcttcggcagccgccttcgcctcccgaatacgctcaccgtcgggatgaccgagacgctccgcgagatcgggccggccgacctgtcgcgcgacgcgcacgaggcggcggcgaatcccgccgatcacgccgcgcgccgagcgcccttcgccgagacgatcgggcaggtagcgttcgacggcctggcgcacggtcatgcccgcgtaccatgcgcgcagcgcggccagttcgtcggcgtcgggatagcctgcgggcgcaggcgcggaatcggaggaaggcggtaaggcgaggcgcggtttcatgggcgccagtttgacagaagcgcgcgcggccggatacgtcgcgcgcggcgttccggggcggccggcaccccggccgggcactccgggaacagatcgcggccaagatgatcgcgctggcgattgccgagcggaacgaaggccgcatcgacaccgcgctcgacgcaggcaatttctcgggcgacctgttgaacggtatcggctacgacctcgtcaacgccggcctgaagatcaatcgtgcgatggcgatgatcgatgcgcgcctcgcgcagtcacccgatgccccgtatgcgctcgacagcaagggctgggcgctccatcgcctcggtcgcgacgacgaagcgctgacgtggttcgaccggccgattcaggattcagggagcgacgccgcgtaacgcgtcactcctcgcctttcgcgcccggattgagcatcacgacgaagccggccacgccgacgaccagcgcgaccgcgccgccgcgcagcgccatcgcgttgtcgaacaatagccccgtcacgacggccatcatccccacgagcgagacgaacacggcgatcgccgcgacgacgatccgggattggcggcgtatcattgcgccccctccgggttaggcggccgcagccgctacgtcggcatcgtcgccgcgaatcagcagcaccgggcacttcgagccgcgcacgaagcgctcggcgacgctgccgagcagcacgcgccggatgccgcgccgcccgtgcgtgccgaccaccgcgagatcgatcccgccttccttcacgtagcgctgcaggcgttccgagatgtcctcgccgatgctctccgtctcgacgagttcggcctcgcctttcgcaccggcgagcgcgatgacctgctcggcttcgcgcagtaccttgcgcccgtcgtcgcgcatttcctcgacgagcgcgtgcggatcgaaacggcccgcgtaagtgaacagcaccgacttgtcgaccacatacacggcactgacttgcgcgtcgcctgccagcgcgacctttacggcctcggcaagcgccagtttcgacgaagcgctgccgtcgacggccaccatgatcttcttgtacatgcaaacctcgctggggtgaattgccgcgcggctgggtgcgcacggccctgtcaccatcatcggcggacggcgggttcgaatgttgacggcgatcaagcgagcgaccatgccggctgcgaccggccgacgcagggcgcggcacgcgcgccggagcccgcacccttgtgcgtcctcgcgtatgcggcgcgcgatacgtgtgcttgtcgaacccgccggcgcgcgacggcatccgccgggcccgcggcggccgcacgccgcccgtgcgcaccggaatcgagcggccaccatgccgaaggcgctatcatcggatgtgcgactttcgtccggcccttatttgccggcccactttcaactcgctcaaccgacatgacaacgactaccgaacgcgtggacggcgccgcccagcatctcgtcgccgcccgccatgccggctcgcccggcccgctgctgcccgatgcactgcgccccgacgacatcgacaccgcgctcgcgatccagcagcgcgtggccgacctgctcggcgaatccgtcggcggatggaaatgcgcgctgccgccgcccgaccgcgtgatcctcgcaccgatcttcgcgtcgaccatccgcgaggccgatgcgccgtaccgcgtcgtcggcggcccgatcgtgcggatcgaaccggaaatcgcgttcgtgctcgatcgcgacctgcccgcgcgcgaacagccgtacgacgaacaggacgtgcgcgacgcgatccgcgaggtgcgcatcgtgctcgaggtgctcggctgccgctatgcggagcccgcgcgcgcgtcgaagttcgagctgctggccgacgggcaattcaaccaggggctatgcgtcggcccggtcgtgcccgacgggctgaacgtgccgctcgagacgctggcgctgtcgttcgaaggcgcgctgaaccgcacgatcgacggccgccacccagacggcgatccgctgaagccgctggtgtggctcgtcaacttcctcgcctcgcgcggcgacccggtgcgcgccgggcagatcgtgacgaccggatcgtacgcgggcgcgatcgacgtgccgctcggcgatgcgctgacggttcgcttcggcgagctcggcagtttgtcggtgacgttgacggcctgatgcacgcggcgcgcgggcacggctgaccgggctggtcactgataactgatcgctggccgcagcgcgacggccgcgctcgttgcgcgaccggcttcgcggcaggtgtcaggcgcgcggctacgcgcactgtcgtgacggcaacgtcattgcggccacgccggcaacgacgcacgcgagcccgagccacgccgatgccgaccgcgattccccgagcagcgccatgccgatgccgatgctgatcggcacgcgcagacaggcctgcgccccgtcgtgccgaccgaaccgagcgtctgcacgagccggaagtagatgatgaacgcgctcgccgcccgtgccggcagcgatcgcgacaacgggtgaagcgtccacggacggtcggcggcgaggctggcaggcaccagcacgatcgccccgacgatcagcgagccggcgggcgacatcccttgaacgaccgcccgtagcgcgctgcgcccgcctgcatcttccgtacgacgtgataacgttgcacatccccgcgcgcaccgcgccctaccccgtggcatgcgcaccgctttcacgccgatatcgaacatgtcgctgacaccgcttcccgccctgctcgacgaaaccctgcgcaccgtcgtgcgccgctaccggctgccgccgctcgacagcgcgtcgtcgccggccgacgccgcgaacccggccgccacgcttgcgatcgtgatcgaggaagcgcgcaggatgcgaagcgacgggcacacacccgacgcggcgctgcggcagcgcttcatcgacgccctcgcgcagatgatccgcgatgcgatggatacgcattccggcgatcccgcgtttcaggccgcggtgctgcggcacgatgcgccgagcgtgcgcgaatacgcgtcgttgtcggcacacgcggaacaggaccgtcgcgcgctgcactcggccgtcaacgcgatcgcgcacccggccaagctcgagcgcagcgcccggccgtggcaacgcgacgggctcgcgcggctgcatgcggccgccaccggcgcgtcgtgggccgatctgcacgacacgctgcggcacctgctcgcactgcccgacatgaagaccgacccggccttcgaacaggacatcgtcaagctgaaagacagccccgcgctcgaacgcctgctgcgcgtcgacgcactggcatcggacgagcacgtgcgccgctaccgtgcgctgtgggtccgccagggtccgctcgaaggcagctcggtcgccgttgcacagggcgtcgcatcgcagcagcgcggcgcagccgtcgaagcgctggccgcgcaggcgctcgacgcgctggcccgcaggctcgacgccgtcgacgcacgccgcacgtaccgggtggtgacgtcgatgcgcgtgccgtcgtcgataccgggccggcacgatcgcgcgaaaaccgaatgggacgcgatcctgctcgaacgccctcgcggcgacgacccggcgcccgcgtggaacgtgcgcttcctcgtcgaagcgaaagcgtccgcggatgccgcgacgaccgatctgccgcggctgctgcgcggcctgaccctgctcgcgcaggccgccccggacacgatctattcgttcgagacgcaccagggcacggtgcgcgtgcacggcgcgtcgctgcgggcgctcacgaccgacgacgccgcgctgcaacgggaagtgctctattgctgcgatgcgtccgcggacgcgacgccgcgcctgctgggcgccgcgagccggatgcagttgctgtcggcgcaagccagcctcgaatacgcgagcgcgctcgcgcaacagccgcacaccgttcccgacggcctcggcgtcgtctggcacgcgctgctgacgatgccgcaatggcatgcggtgctgcaccagtacccgtcgttgcggcaggtgcgcgagctgatggtggcgatcgacgacttgcgggccgcgatcgacgaggtcgatgaaggcggtgcggccagcagcgtgtacgcgtgacgcacgaaacgagccgcctcgcggcggccggaacgcgcggcccgctcagttggtgagcacgccgaacggcagcgtccatcccgccagccggccgccatccgcccatcgatcgccggccgcatcgcatggcagcagaatcggcgcggccgcgcattcgagcgtttccttcggcgtatggccgaactccgccttgaacagccggtggaaatacttctcgtcgggaaaaccgtgcgcccacgcgatctccgcgatgcgctgatgccggcgctgcgggtcgccgagcacgtggtacgcgtgacgcagccgccgccgcgtgatctgccgcatcacgccgccgtcttccttgaacagctggtagagccgcgctctcgacacgccgatgtcgcggcagatccggtcgggatcgaggtcgggctccagcagatgcacgtcgatgtagcggcggacccgctcggccagcgccccgtcgatcgggccgcgtgcgtcgtgcagcgcctgcgcggtcggggcaaccgccgcggcgagcagcagcagcatcgactggacgatgctcgggatctcgtgcgtgcgcagattcggcagattgcggaacagcgacagcatgtggtcgccgagcagccgcccgacgccgctcgtcagcgtctggccgtgcgcctgcgccgcatggctcggcagcaggtacctgggcacgaccaggctgatcacgtcgccggcctcgaccctgcagtcgttgatctgcgcgacgtcgtacacgaacacgtcgccggcgcccttgaccagttcgggcccgccggtgtggctggccagccggccaccgagcagcagcgtgaagcggatcgaatcctgtccgtcgaggcggatccgccgcgtggtccgatgaacccggtaggccggcgcgcgcgatcgccagtggcggcccgacaggatcagcgggccgagtgccgcgccgctcgcctccgcgtcgaacgcgccgtggccgccgtcgtcttccaggcggcagtcgcacagcatgtccttgacccagacgtggaacctgtcccgctcggggtagtcgatggtgcgaaacttgaaaacggggacgaatgccgcttgatccatgacagtgtttttatcgagccgacacgagaggatagatcggttcgcagattatcggaccaaattgcgccggcgcaaggccggcgcggcacatcgtccacccaggcggtcgacgggcgccccgtgacgggtgccgtcgtcgtcgcggccatcagcgttgcggatggcattcccagttgttgtacgtcggccgatcgatcggcgtgagccccggaatcatgaacaccgtacagccgaagcgccgcccttgccggtcgtcgcgtcgtaactcaccttctggccgccgagcccgtccttcttcccgtactgcacgttggcgatcgtgatctcgtccgacgacgcgagcccgagcgtcttcgcggtcgacgtctgcacgtcgaccatgttcatctgcgtcgaaccgcacgcggacagcacgaggccggcggccgccgcgcccagcgccgtccgcaaggtgacggcgcattgcaggatctgcttcatggtttctccttcgaattcccggtggggcacgattacgagcccggcgtaaaaagctggactggatctggctgccgacgttcgcgacgaacgattgccagacgagcgccatcgcccccgcggcattgacggccagcgccggccatgacccgtcctgcggatccagcgtcgacgtgctccacgccccgttccgatagccggccacgaggaggagcgacgcgttcggcgtgcccgtgtcctgccaggcgacggtcacgttgccggccgcgtcgatcaccagcggcgggtactggagcgccgccccgttcaggtgttccgtcagccgctgcagcgtccccagtttccgccggcatcggacacgctcgcctgcaggaccgcgccccttccgcccacatcgcggcggccacgccgttttcgttgacggcgagcatcggcgtcgcgatgaaacccgtcggctcgacgatcgccggcgccaccggctgcgagggctgccatccggttccggcgacgtagcgctgcgacatcgtggcggtgtagatcttcccgcccgtcacgtcgagttgccccagagcagcgtgatgttgcccttcgcgtccatgccggcgaccggcgagatgatcgtcgtgaacaggctcgtattcgatacggcctggttgacgttggtccagccgttggtcgcgtcgtacgtggccgtccacagcgccgacttcgtatggttggtctgccgccatgcaagcaccgcgcggccggacgacaggaccgacagcatcggcctcacgttgtccgtatcgccggtcaccgcgcccggcccggtctgcaccggcatctggaccagcgccgtcggcgaccactgtccggcctgcgtatagcgcgtccacgcgatgcgcgtgtcgagcaggctgatcgactgtgtccatgtgacgagcgcgttgccctggctgtccatgccggccgaataggacgaaccggccatgtccggcaccagtgcgaccggggtgccccaaccgccattcggggtgtacgggcgcgcccacagggcgtacgtgttggggcccggcgtccactcggtccagaatgcgaccgcctgcccgctcgcgttgccgaccagttgcggctgcaccccggtcagcgaattcatcgcatgcgaaccgtcgctcgtgtcgagccgcgtcgcgcttccccaacccgagcccggcacatagcgcgcgccccacatctcgttgccggtcgtgccggccgtgccgttggtcatccaggtggcgagcgcgttgccgctcgcgtcgatggtcacgctcggctcgccttccggccccttgccgtccaccgcggcggccttcgaccagccggcctgcggctgcgtggtcccgccgcccgtcggcccgccattcgagccgccgttcgaaccgccattcgaaccgccgccgggcgaggtcgaaccggaaggtgaaccgggattgttcggcgacgacaacgatgcgccgccgttcgtggcaacgtcgtcaccgccgcatgcggacagcgcgagcgcggctgccatgaccatccatgcaatgggtttcatcggaatcctctttttctctttccggcttactctcgtctgccgttcgccgacacgctgtaccgcaccgatcggcttcttgataagcaatgctattgaacaggcacgaaaaccggcgtccgttcgcccccgtcatgctcggctccgtcgtgcggatcgatgcgaacaccgccttcggcagaccgcccccttcgggcagcgaggacgacgaccgacgtctatcgtcgaaggtccgtcgctgccggctgcatcttaattcaggcggtccggattcaaggtggcgatgcgtccacactgagtggacttccatttcgccggcccgcgtgcgcgcgctcgcggccggggccgcgggtgcggtacgatacgcgccggggcgaaacgcctcacctgagagacccggccgctgcggccccacacccggcacaagaaaaaaatgcccagaaacccattgctgcaccgacacttgttcgccgcgctggcggccggcctgttctggattccggctgcccatgccagcggcgacgatggctgctacgcgcccaccacgctccggcagaccgcctactcgtgcgccaacctgccgatgttgagccccgcgaacgacacgcgcatcaacgcgatgctgatgatggtcgacagcgccaaggtcgcgcaggcgtttccggacccgaagacgatccccgcgaaagaccggatcaaccagatcatcgtgccgtttccgatggacttctccgggtggatctacatcgggcagaaggagcctgacacgaccgccaaggccgacaacgcggcggatggcgacgcgtcgtcgaaccgctacgccgacggcgaaggcagcatctgccgcagcatgaactcgggcgccgacgcgttcaacgacgcactgggcggtgccggcggcctcccgccgacgaagccgcacgcctgcgcgcggcccgtgccgacatcgcgcagaagacctgcgccgccggcgccgcgagcgtcgcgtggacgaaaccgccggtcaagtcgcagctcggccagcagttcgccgcgtacctcgacggtacgaacgcgttctaccgcgccgacttcctcaccgcgacccgggccttcgcgaacgcgtcgcacagcgcgaacccgtggctgaaggaaaccgggctctacatggccgggcgcgcgcagctgaacgccgcgcaggccaacgtgttcgacaacgacaacccgacgccgtcgctcggccgcgtgacgaaggtatcgctcgacgccgcgaatactgtgtttcgcacctacctgaagatctatccgcagggacgctacgcgacctccgcgaacgggctgttgcggcgggtcgcgtggctcggcggcaacgtcacgcagcaggccgacctgtacggccacgcgctcgcgcgctggtcgccggcgacgtcgaacgtgccgctgatccagctggcgaacgaactcgacagcaagctgctgttcggctcggaattcgatgcgcgccagatccagtcgccgaccgtgctcgcgaccgtcgacctgctgcgcatgcgcacgtcggacaacagcgattcgagccgcagcaagccgctgaccctggacgagctgcaggcgcagaaaccgcgcttcgcgaatgcgcccgcgctctacgactacctgctcgcgacctggtatgtccagatcgggcacaagccggacgccgcgctcgccttgctgccgcaggcgcccgccgagccgctcgactacttcggcctgagccagcaggcgctgcgcgggttcgcgctggaggatagcggccaggccgacaaggcgcgccagctgtggcgcgacctgatcccgctcgcgaaattccgcttccagcgcgaggcgctggaactcgcgctcgcgatcaacctggaacaggccgggctcgtcaacgacgcgttcgccgacgattcgcccgtgcagaacgccgcgatccgcgccgtgctgctgcggcgcgccgccaacgcggacctgctgcgctcgcaggcacaaaacccggcggccggcggcgcgctgcgcgacaccgcgctgtacacgctgctgtacaaggaactcacgcgttcgcactacgccgagttcatcgccgatgccgcgctggtgtccggcacgcctgccgatccgttgaagccgttcgtcgcgtccggtgcgaaaaccgaagacggctacacgtgcccgtccgcgcgcgacatcgcggcgatgctccagcagaatccggccgacgcgaaagggttgaactgcctcgccgagttcgtgcgcgtcaacccgctcacggccaacctcgaaggcgatgtggtgcctccgtggatgcgcaacgcgtcggcggcgaacgccgcgcgcgtgccgccgacgctcggcgcggcgccgtcgcagttcgcaggcaagccgtacgagcggatgtcgagctacgtgacggtgatggccgatgcgcaggcgaatccgaccgaccgcgcgtatgcgtactaccgcgcgatcaggtgctatgcgccggcaggctccaacgaatgcggcggcaaggacgtgccgaagaacgtgcgcaagcgctggttcgacacgctgaaggccagctacgcgggcagcgtgtgggcgcagaaactccgctactactggtaagcgccgcgtgaagcgtgtcgcgtatgtcgcgtatatcacgtgtatggcgctgctgctggccggacgcgtcgcgctggccggcaccgtcgatgccgcgcagtacgacacgttctggctgtgggcgggcgtgaagccgcaggcggtcgtgcgcggcgcccgcgccgtctacgtgctgcaagggcagatcgaggcatcgccgcgggacgagtcgcaagtacgcgtgatcgcgcagggcgtcgcgctgccacccgcgccgcatgcgcgcgtgtggctcgtctatcgtgcgcatacgctgcgctggacgccgcgcgtcacgcagatcatgctcgcgcaactcgaacgctggcgcgcgtcgggtcgcacgatcaccggtatccagatcgacttcgatgcacgcacgcgccacctgcaggactacctcgaattcctgcggacgctgcgcgagacactcccgccgattgccggctgagcatcacggggctgctcgactggagcagccgcatcgataccgaccaggtcaaccagctcagggaatcgtcgacgaagtcgtcgtgcagacctaccagggccgccgcacgatccccgactacgcggactacctgccgcgcgtcgcgcggctgcaattgccgtttcgcatcggcatcatccagggcggcgaatgggatgcgccgccctacctcgcggcaaacccgtggttccgcggttatgtcgtgttcctgcgcaacgagtagcgggaaacacgcgacgacgtcgattgttcccgtgccccggattcattccgggcgcggcgaacccgcatccacgtacacccacgcgctgacgcccgattccagcaccacgcgatcgcggcgatacgcgtcgacttcgtagtcgtccgcgtgctgcagttcctcgcgcgtgatcgcgaacacggtgcccgtgacgcggtcgcccggtcggccggtataagccaccaccggatgatgcgtcttcccgctcgtcgcgaccacctccggatcgtcgatcttcagcatcgtcatcgcgtaaccgggcatcgcatcctcgcgaccgtcgagcttgcggccgaaggtggcgagctgcaccggttcgagttgcagcgtgccataggaaaagaggtgctcggagaaagtcggggcggtgctggacatgattgaactcgacaaaaacaggacaaacgaaacgtaacgcagatcgcccgcaggcttacgcgccacccgagatcgcgccgccgagcccggcaagcgcaatcacgagcagcgcacccgccgacgaggccgtgatccatcgttgcttgcggtgaatcagcggatggttgatcgcggccatgtagccggtcatgatcgtgaaatcgaccgcgatccacagcgcggccaggatggccaggctcacgcgggaatccggcgtgatgccgacgaactgcggaaagaacgcgacgaagaacagcaggtccttcgggttcgcgatgccgacgagaaagccgcgcaccacacccggcaagcgccacgcctgcgacgccggttcgcctggtgcggcaccgttgccgtcgcgcgtacggccggcgcgccattcgccgagcagcgtccggacggccagcaccgcgatgaagacgcaacccaccacgtgcaaccccgtgagcaggcgatcgctgacgagcacgacgccgaacaccatcagcatcgcccccgcgatcatcacgaggctcgcggcattcgcgcccaccgcggtcagcatgccctggcggaacccgcgccgcgcgacggtgccgaccacgagcatgacgacggggccgggcgtcgcgatgagcagcacgatcgcggcgagataggcgaacagcagcgggtaatggagtgccatgacaaaaagttgttggatggatcgacgcgcgggcgcgctacgatggcatcatcggaattcagcgcgacggattgcacgggtttttcgcagtatggcgtgcccggcccgctgctgaaaaacggaaaatcctgtcgattgacatgagttttattcatattcaagccccgtgaaggccaaaccgcttcccctgtctacgcattgcgcgcattcgaaagcgccgcgcgcaccggctcgtttacgcttgccgccgaggaactgagcctcacgcagagcgcggtgagcaagcacgtcaggacgctcgaggcctacttcggccggaaactgttcgtccggcgcgggcccaggatgaccgtgacggcggaagcgcagatcttcgcgtcgggcctgcggcgcggcttccggcagatcgaggaagcctgcatgctgttccagtcgcaacgcgacgtgctgcggctcaaggcgccgtccacgctcacgatgcgctggctgctcgacgcgctggccgcctttcgcgacacgcggcccgctttcgaggtgcagatcgcgagcgtatggatggatgtcgacacggtcgatttcttcagcgaatcctacgattgcgcgatcctgctcggcacgggcaagttcggcgaggccacgcagtgcgtgaagctgttcgacgaatggctgattccggtgtgctcgcgtgcgaccgcgacggtcgcacgcacgaatccggcggcgtgcgagctgatccacccgtcgcccgaccggcgcgactggcgccgctggctcaagggcagcgggcacgacctggacgtcgacatcacgcgcgggcaggtgttcgacatgctcgaacagggcatcgcggcggccatcgccggccacggcatctcgatcggcgatctcgcgctgtgcgcgacggcaatcgacgagaagcagctcgtgctgccgttcaagacggccgtcaataccggcgacgcgtactacctcgtctggccggaagactccggcaaagccgcgcaggtgcgcgaactcctcacgttcctggaaggccggatgccgcgcctgacgtttccgggcatccgcttcaacgggcctggctgagccctgcggccggcgaaccggccgcctgggcgacggcgcgacggggctgacgggcgctaccggccacggttaccgggtgccgccagccgtccaaaaacggcgcagcccgccgaagcgggcctgcgccgagcgtcactgttacgcctgcacgaaagccagcaggtcggcgttgaggacgtccgcgttgaccgtcagcatcccgtgcgaatagcccggataggttttcagcgtgccgttcttcagcagcttgatcgacttcagcgcggcatccgcgatcggcacgatctggtcgtcctcgccatgcagcacgagcgtcgggacggagatcgacttcaggtcttcggtctggtccgtttccgaaaacgccttgatgccttcgtaatgcgctttggcgctgccttccatcccctgccgccaccagttccggatgacgccctgatgcacggttgcaccttcgcggttgaacccgtagaacgggccgctcggtacatcgaggaagaactgcgcgcgattgtcggcgagcgctttccggaaaccgtcgaacacctcgagcggcaagccttcggggttcgaatcggttttcagcatcagcggcggcaccgcgctgaccagcaccgccttcgcgacgcggccggccggctcgccgtgcttcgcgacgtagcgtgccacttcgccgccgccggtcgagtggccgatatgcaccgcattgcgcaggtcgagcgcttcgacgaccgcgaacgcatcggccgcgtagtgatccatgtcgtggccgtccgacacctgcgtcgaccggccgtggccgcgccggtcgtgcgcgatcacgcgatagcccttctggacgaagaagagcatctgcgcatcccagtcgtcgctcgacagcggccagccatggtggaacatgatgggctgcgcgtccttcgggccccagtccttgtagaaaatctcgacgtgatccttcgttgtgacgtatggcatcgcgatgctcctgtgacgtggatgaacatggcacactggccgggagccattatcggacagtattgtcaaacgatgacgccacgatgcaagcggccgtaaacaatccgaccaacgtgccccctccccgcccgaagggcgaacgatggcgctgcgtcaactgtataaggctggactggaccgaacagacagcgtcagatcgtctgactcggttcggtcataatgcgccatacacctgcacgcttccaacgacagtcgaatgtcgatgccgcgcgagacagcggactatgagtcgcaagccgattcggatgttcgtcaccaaagatggccacttcgcgtgcgagcggcctgtctagctctgacgacggacgttcagcagaagtccacctgacgacgggcggcccatcactacgctatctgggtcggccccgatcgcgggctgcgttggcagatcgactacgcgaggctatcgggagcaagttgtaaaacccgtgcaggtgccgccctgaaggtcgggctatgtgcatcggccgcaatcatgtgaggcgttacgtcgtgtgccgccaatgctttagttgacgcccagcgttcgatcaagacaaatctattttcgtcgccgacgacggaatggagatcgtactggagacagccttgctccgcacgcacaagcggcgctaatttttcatatgccgcgatttgctcgtggcctttgcctggaagggtttgaatcgagataacaagcatcacctcccgttcgcaatctcggcagtgatgatctactttgctcatgacgactccgtgctggtgtgataccgacgaaagacgatcagccgtaaacgcgaaaggccccgtcttttgccggcggggccctgaaaatatgcagcgacgatgattaccgcgtgcgcatcaaggacgacccaccgttgccgatggtcgtcgttgtaatgacagtcacgaaaggaatcagattgcgttgcatattgccacgctaactcactcgccgtaggcaggtcaactccactgagacctgcacacacttctacgttcctcgaacggcggttgcacatttgaaagccgccgtcgaatccgagcggattcgagaggcagacgtgggtcgccaacggcccttgatgaagtgacggtgaacaggcccatcaggaacgacgacggacccatcaccgacaccgtgaccagcatcaggttgcgccgagcgtgccgcagatcaccgcgccgagcggacgggccgcgagtcccgcccagaagctcactagcgacgcggtcgggtcgagcgacggaaagaacagcttcggagatcgtcgccgcgacgacaccgtacaacgcgaagtcgaaccattccagcgccgtgccgaaggtggcgcgtgccaccgtgcgacgaaccatcaggtgatccttggggacgctcgggcacagttcgagcgccgattgtgggcgcgatcggcaggccaaccacgccacagcccgcgaagacgatccgatagcgctgccccttgctcgccataacgtgaaatctctcgatgcgctggggcggctagatgaccaaacgaccctactggcggcaatcaaaagcttttggtcaggcctaccccaaggtacggccgcgaccgactgaaaccagttgcatgccggagtacaggctgccgaaagtttcatagcgtttgtcgaaaagattccggccgaacagatagacttcgagatccttgttttccatccaatctgggcattcacaaggctataggcgtcaaggtaataagatttgtcgatatccgcggtgcgcttgcctgtgtattggtatcgaaggtcggcggagagcttgcccggcaaatgaatcgccttggccgaggtttcgtattgcagcccggccgtcgccgtccatttcggtgtgttcggaacaggattgccagtgaccgtattgaccgcggcgccgttggctccgagttcgctatggatgtagccgacgccccggagaagctcaagccttcagcgatgagcgcgcgcgcctgcaattcgaaaccactggtcttgtagtcctgatatgttgtccgaaaggcgccaagcgacggatcgagataggacatgacaccgttcttgatgtcgttgtgatagacgctggcatcgatctgaagacgatggctaagaagatcggccttgacgcccgcttcgtaagtccaccccaaagcggccggataggggttgcccacgatgccatcgaccggatagctaaagagcgggtacacccgtgacgcgtgaccacgagcaaccgacacgtagctttgaatgtcgttcgtccacttgaaggacagtgctacccgacctgtcggataggtttgcgacgttgagttggaaccggtcagcgaagcgaggcccagggagttgccctgcttcatctcgatattgtcatggcttacccggccgccgatcgagaactcccagcggttcgcaaaggggatcgaaacgtccccgaacagtcctaggttggtcgtgtcgagattgcttttcatcgcgactgagccggaatacggaggcggcgcgcactgcgtactgctgcaccagcgtatgccgttggttcgcatggcactggcaccgacgacccagcgaaccggggcaccctcgagtgaattcagccgaatctcctggctgaagatgttctcctgatccgttgagtggcccacgttactggatgcggggaacccgatcgcgtcatagacaagtttgtccacgagatcgagttcgctttccagcttgttgtgctggtaggaactgatggaagtgagctggaaattcttgaaaaatgctcgacggtcacggtggcgcccgcttgcgttgtcttcaagtccggctcggtcaggatgccactggtcggaaactgactggcgctacgcaggacatagagcgggagttagcctgatcatgcagatagttacccgtcactgtgatgagcgtgtcgtccagccccgtgaagcgtagtcctccacggaatgcaccgatgtcgcgcttgcccagcttgtcggtgtaacggctactgatatcgccattctcatggccgtaacggatcgccatccgtccgtcaagttgtccgggcacgatattgccgccaagaactgcctcgcccatgcgatagccgtgttcgccgacctcggttgtcacgtgaacatcccgagttccgtcaggctgcttcgtgacaacgttgatagcgccacccagtgcattggttccccatagcgtgccttggggaccgcgcagcacttcgatatggtcgacgtcgagcaacatgttcgacgcgctcatcatgctgttcggcacaccatcgacattgaatgcgatcgtgccatcggagtagttggcaggcgtcccaagtgaactgacaccgcgaattgagaaccactgggagcctgtggcgcggctgacccattgcacattgggcgcatggccggcgatagccacacctggatcgaagggcgattccttcagggtcttcgcctgcagaaccgtgatgctttcaggcacatcctgaaggcgttcggtcgttttccgggcggtgaccgtgacgggctcaaggactgtgctctctgcgcgcgatgccgacgtgccgctatccggcgactcagtggttgattgcgcttgctttccttcggtagcgaacacgtctggagcagcgacggcgacggctgcggcaatcgttgcgttgagcaatgtatgtcggacggtacggacgacacgcaagccacacgccgggagcccttcgcgcatcgcatcgatcgagcctgaacttctgccaagggattgatgaaagggagagcgatgtaccgcacattgcccttcaatatgaggcgtgttagacattaaacgagactcatttgcattatcggggtcgtcaatttaccgattcgccgacacacctccgtagcgagatttggccaattccttgttcaatcaggccaagtgtatgtctttccatcgagatggccgtattgcgaaataaattgactagatttcgcaatgtagaagtgtggctgcacgggtaggctgcgcctcatcgtggcctgccatgcctgttctctggccggccgagtacttcgtccttcccgaggaatacccgtgcactcacatatcatcggtagatcggccatgcgcggccgttcaagcgccatctcgatcccctttgctcgagcggggcgcgcatgagcaccgccgctatctcccgtaccaaacccattgtcataagcgttgttgggctggtcgttgtcttcggcctgctgtatgcctggcgcgctgttcgaagcggcggcgcagaacaacaggccatgccgccgatgcctgtctcgacgatccgcgcagagcctcgcagtgtggccgacgagtggcaggccgttggcagcctgcaagccgtgcatgaagtgctgctggctcccgatacctcggggcgagtgaccgccgtcaatttcgacgcaggccagtccgtgaaggaaggggcggtgctgattcagctctacgatgcccccgaacaagcggatcgtgccgctgccgtggccaaagccgatttcgcccagttgcaactcaggcgttcgcaagcgttggcgcctaccggcgcggaaccgcgcgaattgctcgaacaacataaggcggacgctgcccagactgccgcggcagtccggcaactggacgcacgcattcagcaaaagtcgattcgcgcgccgttctccggtcagttaggtatccggcggatcaacctgggtcagtatctcaatgccggtgacgcgatcgccacgctgacccagctcgatccgctctatgtcaacttcacgttgccgcagcaggacatgcccaggctgacgtcgggcgcaccggttcaggtaacggtggatgctgtgccggggcgggtattcatcgccaggatcagcgccatcgaaccgcgtatcgatggagaaacccgcaatgtggccgttcaggcgctgttgcccaataccgaccggttgctgaaacccggcatgtatgtgacggcgcggctggtattgcccgccacgacggacaatatcgtattgccgctgacggcgatccagacttcggcctctggtgacagcgtggtggtcgtgaaaggcgccgacgcgcagggagtcggcaaggcggttgccgtgccggtcatcaccggccgccggctcggggaggaggttctggtatcccaaggcatcaagcctggcgacatcgtggtgatggctggccagaaccgtcttccgcccggtgcgaccgtaaaaatcaacagcacgcccccttcggcaacggcgactcctgacgccccggccgttgcgtcctccagcgccagcgcgcggtaaaggaaaccacgccatgcgctttacagacatcttcatccgtcggcccatcctggcactggtcgtcagcctgctcattctgctgatgggcgccacgtcgattttcctgttgcctgtgcggcaataccctatctcgaaaacgccaccatcacggtcagtaccacgcttccggggcaacccaggacgtgatgcagggtttcgtgaccacgccgatcgcgcagtccatcgccacggccagcggcattgaatacctgagttcgactaccacgcaaggcaagagcgagatcaaggcgcgattggtgctcaacgccaacgccgatcgcgcgatgaccgaaatccttgccaaggtgcagcaggtcaagtaccagttgccggcaggcatcaccgatccggtcatcagcaagtccaccgagggcggtacagccgtgcaatacatcgccttctacagcaagacgctgtcgatcccgcaagtgacggatttcgcatcgcgggttgcgcaacctctgctcaccagcattccggggtggcctcggcggacgtctatggcggccagacgctggccatgcgcatctggatcgacccggtgaggttggccgcgcgcgggctgtcggccggcgagatatcggccgcgctgcgcgccaacaacgtgcaggccgcgccgggccagctcaagagcgcgctgactgtcaccaacatcagcgcggccaccgatttgcgcagcgtcgaggacttccgccagatggtcgtgaagtcgagccccggcggaggcgtagtgcggttgtcggatgtcgccaccgtggaaataggcggccaaaactacaatagcctctcgttcgccaccggcatacccgcgatcttcgtcgctatccagcccacgccggccgggaatccactcgagatcgtcaagcaggccaacgaactgctgaccaggattcgtgcaatggcgccccaggactgacggtagcgccgaactacaacgtagcgcgcttcgtcaatgcttcgatcgaggaagtcaaacacacgctggtggaagccatcgtgatcgtgatcgcggtgatcttcctgttcctcggcacgttccgcgcggtgatcattccggtcgtcaccattccgttgtcgctggtcggtaccgctgcgttgatgctggtctgcggtttttcgatcaacctgttgacactgctggcgatggtgctggcgatcggtctggtggtggacgatgccatcgtcgtggtggagaacatccatcgacacattgaggaggggctgacacctgtgcgcgcggccctgctcggcgcacgcgaaatcgtcgggccggtgatcgccatgactatcacgttggcggcggtctatgcgccaatcggcatgatgggtggactgaccggcgcgctgttcaaggagttcgccttcacattggccggctcggtcatcgtctcgggagtggtcgcgctgacgctttcgccggtgatgagctcgatgctgctcagttccaggcagggcgagggacggctggcgaagcgggtcgagcactacatggaagggctgacggcgttctatgggcgcctgctggcccgcacgctagccgctcgcggtgcggtactgctggtcggtgtggccgtgctggccgccatcgcggtgctgttcaccggcactcgccgcgaactggcgccgaccgaggatcagggcgccgtcatcgtcgtcaccaaggccccaatatgcgggcgtcggctacaccgcccgctatgctcagcagatcgaaaagctgttcgagcagattcccgagttcgacagcagcttcatgaacatcggcgactccgccggtggccagaacatgatgctcggtggcgcgatcctcaaggactggtcgaaacgcaagcggtcggccaccgagatccaggggcagattcaagccgccggcggcgccatcgacggcgagacgttgaccgccgtgcagttgcccccgctaccgggttccagcggcggcctgccggtgcagatggtgctgcgctcgcccgacgacttcaagacgctgtacgagaccggcgagaagatcaaggcagcggcctatgccagcggtctgttcctctacgtgcagaacgacctgtcctacgacagcccgcaggcgcacatcacgatcgacaatgcgaaggccagcgaaatgggggtgaccatgcagtctgtcgccgatacccttgccgtgctggtcggcgaaaactacgtcaatcgcttcaacttccacgaccgctcctatgacgtgatcccgcaagtgcgcggcgccgagcgtatgacaccggaagacctcgggcgtttctatgtcaaaacgacctccggcgcactggtgccattgtcgaccgtgacgcatgtcgagatgcgcccgcaagcgaaccagctcacccagttcggccagatgaattcgaccacgctcgaaatgctgccggcgccgggcgtgagcatgggcgaggctgtgaagttcctgcaatcgcagccgctgccgcccggcaccagtgtggactggctcagcgacagccgccagttcgtgcaggaaggcaaccgtctgctggtctcattctgcttcgcgctggtggtgatcttcctggtgctggcggcgcaattcgagagcctgcgcgatccgctggtgatcctggtgacggtgccgctggcggtctgcggcgcgctggtgccgctgtggctgggctttgccacgctcaatatctacacccagatcggattggtcaccttgatcggcctgatctccaagcacggcatcctgatggtcactttcgccaaccatatccagcaccacgaaaacctgagccgcatcgaggcgatcgagaaggccgcggcggtgcggatgcgtcccgtgctgatgaccaccgcggcaatggtcgccggccttgtgccgctgttgtttgcagacggcgcaggctcggccagccggttctccatcggcatcgtggtggtgatgggcatgatggtcggcaccttcttcacgctgttcgtactacccaccatctacagcttcatcgccaaggatcaccgggcaacagcggaaagttctcgcgcccgcgaactcgctactgcggaggctcccgatgtcgccctttaaaccggttcctgcgatgcctgttgtgtcgcgtccggcgacgcttcctctccgcgcgctgccttcatggcagtggccgtcgccgttatcaccgcaggttgcgccagcggccccgattaccacgcgccggccttaccggaaaccgctgcaggcccttcgtcagtcgcccatccaatacggatgttgccgaagcgctgcccgcgaactggtggaagctgtatgacgaccccgcgctcgacaagctggtgcaggaagccttgtcggccaatcccaacctgcgcgtggcgatggccaacctcgatcgcgcgcgggccatctacacggaagcgcgcagcgggcaattcccttcgaccagtatgtcaggaggcgtgggatacgggcgcgatcagaccacgtggtccggcactggccaggcccccgcgcaatggagctacagcgcgggcctcgacgtctcctatgaactcgatctgttcggtcgggtcaggcgcgacatcgaggctgctcgcgacgacaccgatgcagtcgccgccgcctacgatgccgccagggtcgttgttgttgcggagacgacgcgggcctatgtggacgcctgcagctacggtgagtccatcggtgtggcgcgctcgtccgtcgaactggcccagcgcagcctggatctcatcgacagccaggcgcacgcgggctcggcgtcgcatctggatgtcgaacgggctggcctcacgctagcccaggcccagtccgcattgccgcccttgcaaggccagcgcgaagccgcactgttcgagctggccgcattgacggggcgcacgccctcgcaagtgccggaaccggcgcgtgcctgcaccaaggcgcccgagatttccggtgcgttgccggtcggcgatggcactgcgctgctgcgtcgtcgccccgacgtgcgtcaggccgagcgccaactggcggcggataccgcccgcatcggcgtggccgtggcggatctctatccgcgtgtcacgctgggcgcttcgggtaactacctgcgcaacgactacctgaaaggcaatcgcaccttgtccttctcttttgggccactcatctcgtggacgttccccaacatgatggtggctcgaagtcgcattgcgcaggcgaaggcacaaagcgcggcgtcgctggccagcttcgacggtgccgtgctgaatgcactgaaggagtcggagcaatcgttgagcgcctatggcgcggcgatgcagcagcgcgatgcactggtagaggcgcgtgaccgtgccgagaatgccttccggctggccgaccagcgctaccgcgccggctccatcagctacctcgacgtgatcgtggcacagaccagtctgatcgacgcgaaagcccaggtggccgctgctgaccagcgagtcggttctgcgcgagtcagcgtattcaaggcgcttggtggtggctgggaacaggccagtacgcagtaatgcttgagggcatcggcgcgtgggcgatctcaccgtcgcgccgatgtctgatgccaaccattagccacgcggctccgcgttgtcgcgaacaaccggaagttcagcatagcgaaggaatacggatatggacccgcacgacgacccgcctcggatcattgacctgattacatcattcggtagcaagagcctgccgtctggcaaacacacgatgaagcacaccacagcagcctgtccggcgaccacaccgccgatgtcgtctcaggaacaacgattggcggccagccgactgcgaccgacgatcgctcgtacccgtgtcctgtccgtactggaacaggcggcgccgcgctgtctcgatgccagtcaaatgtatcgcatcctctgcacgcaacttgacagcctcaaaccggcctcgatctaccgtgcgctgaatgatttatggacctccggcttgctggtccgtacggagggcgcacaaggccgcgcactctacgcgctcaagccggacaggaagaaccttcagaacgacaccgtgcgctgccactgtggcgcgcggttggtttttattgaggatcgggcattgcacgagcatctccgatcactggcgaccaaggaaggcttcgatctcgacaacgagccagcttttaccatcaccgtgacgtgtgcggaatgtcggccgttccgcaggagaagagaataggtgaccttaaaccgaggtcgcccgatctgacagcgcctcgccgctttttgctgcctggcctccatgctcggtggacgacggcacgctccactcaaggtgagacttaatcgggaagcacgatgccgcgtacggcatcagactgcgcgtttgtcgttcgatcggaaaggtatcgtgctggcggcttgcctaccgccttgcggaacatggtgatgaacccgctggcattttcgtagcccagctccagcgccaccgtttgcacgctttcgccgatggtcaggcgttgaagcgcaaggatcacatgcagttgccggcgccagcgtccgaagctcatgccgatttcgtgcagcagaagccggctcatgcttcgctcgctcatgccaatgcgggtagcccaatcgctctttgaggttttgtcggtaggatcggccaacagcatttccgcgagtcggcgcaatcgcggatcacgcggcatcggcaaatgcaggtcttctaccggagccgccgccaactcatccagcaacgcggcaatcagtcggtcttcccggccgcccgacgggtatgacgcgggaagccggccaccttcagaagcaactcgcgcagcaatggcgagacggagatcgtgcagcaggttttcggaagatccggtgcggcatcaggctccacgaacaggcaatgacattcggtttcaccggatccccgtgccgagtggggcaagtctcccggtatccataccgcgcattgcggcggcacgatccagacaccgttttcgatttcgcagttgaggatgccacggacggagtaaagcagttgcgccctgcggtgccgatgcctcgcatgttcccagcctttgctaccgacatggcactcagggcgacaacgggccggggcaggttatccacgtccttggccacggccggatcggtgatggcaatgcttgacatgatgcgtatcgggcttcggatccaagatgaggcgctggcctaattgaaaatattatggccaacttgtgcaatgacgtccagtcattccgccggtatcgtgtgattgaccatgctggtcgttctgctcgccagggctattgcgctgccggtccggaggggtatcccatttttcttgacgaagtgggactgccagctatttcccgtgatgcgccgaaggagtattggcatgttgattgacgcctcgaagttccccttggtctggatgcgactaaacgcaccaggcaccgaccccagtctcgccttttgccgagttcgagggattgctcgcacggaaggaagttttcgtcttactcaacgacgaggggcttgataaaggcgaacacgaacattcaccggaagaaaggaagcaaacctcgctttggatgaaacgccacaagagcgaattgcggaccttcgtcaaggcagggatctacatcgaaccgaataccgccaagcgactggcgaccaaggcattcgctttggtatacgaaaaattttggggctatcccatgctcacggttgcgacgaaagacgaggcgctggccctggcgcggaggttgttgctgggcgagcaaacggatgcatggtcgcactaggcccgactaatgaggtcggtcggaatctggagcccggcgcgttaagaggcggtacgagcactgaagaaatgaggcaggtcaatggcatcgaaaacggtcgaaacccagcgctccgtctccgtcggcagcaagattcgcttgctgcgccagcgccagggtcgcacgttggacgacgtcgcgaccgtctcgcagctttcaagccctttctttcgcaggtcgagcgagatcacgccagcccgtcgatcacttcgctcgcgagcatcgcgaaagcactgggcgtgtccgccagctatttcatcgatacgccgaccgaggaaagttgcgtgcgacgtcgtaaggatctgcggtacttcgccttcgccgattccgccgatctgctcgcgcgcctgtcgattcggccgggcgaccgccaactcgaagcgattctcgtgcgcatgtcgcccggcgagcgaccaggcaaaggaaccacgcacgcgtgcgaggaattcgtgcatgtgctcagcggtgaagtgacaatcacgctggaaggcaaaacgttcgtgctcggcatgggtgacagcgcgcactatgaatcgacaattccgcctatctggaccaacacgcgcgacgacgaagccgtgctggtctgggtcggcacgccacggctgctttgaccggcgcgcggcgcgcacatggacgcgcggcgactttgtgaggccgtagacgcttttcgtgccccaccatcgcttccgccccctccgatccgtacctcgactcctttccccgtcgaacggcgtttccggccggagtgctccgttacctgcccttacactgttggcacggcgaccggctggagtgggtcgatctgcgccggtcatccgtcacggagcggccggccccattcgatcaggaaacgacatcatggtgacgcctgatcctacgtttgtagatccgttcactgcgaaaagcggccgtccgtacctcgctgagacgaaagtccgcaaagccgacttgctcgatgcggctatgccggcagaagacccgcaatgcgataactttcaattaacccgtcatagacagaaatatcggagcgactcctggcaatgagctgagcgccggcgacggcggcgtagatggcacgagcacgccgttcgctatcctcggcgctgaccacggccgcgtcggacagcaccttgctcagccacgcaacattcacatcggcaaaagtctggacctctttcgtcaccgtttctggcaagtcatcagattcggcagccatgaagctgcacaggcatatgcgattgccatgctcaagcgccttgcgaaacgtatcgggatagcggcgcaggcaatcgatcggatttgcggattcggccaaaatcgcatccagcgcagctgccgattcctcccaataccgcctcgccaccgctgcgccaagatcggccttgcttgcgaagtggtgatagatgctcgcggccttgatgccgacagcttcagcgagatcacgaaagttcagcccgctgtagccgtgcgcctgggcaatctttgtggcggccaccaggattcgctccctggaactcaggcctgactcgttcttcactctgctaccgcctccacgaccgttgacacccgcaattataccttctactgtaaacctaacgaacgttaggtagatgtgggtatccactcccatatcgtccgaccccgtgtgacaaaccgcatagagaggcacgcatggctttcagcaccaccgatttcgacgtaacccaactcccgatcatgacgatttacgatttcccaaaggcccctatccgacacgcgtccgtatcgccctggccgagaaaggtctgcgatcgcgcgtcgagttcgtgatggtcgacctttacaaggggagcacaaaggcccgagttcatctccgagaaaaactactcgggaacgctgccggtcctcgaactaaacgacggaacgtgcatcgccgaatgcaccgccattaccgaatacctcgatacgctcgatggcgcacccacgctgaccggcaggacaccactcgaaaaaggcgtgatccacatgatgagcaagcgcgccgagctggagttgctcgacgcaatcagtgtctatttccaccatgccacgccagggttgggacccaacgtcgagctctatcagaacgccgaatgggggcttcgtcagcgcgacaaagccctgaggggcatgcactacttcaatgacgtcctgaaaaagcagccgtttgtcgctggggatgccttctctatggccgacatcaccgttatcggcggtctcgtctttgcgtcaatcgtgaagttaaccgtgcctgcggagtgcggggcgctgctggattggtacacgagaatgcgggaacgtcccagcgtcaagaaccagccggcattcgcctgaaacagcagtcgtgcccgaccgtcatcgacggtcgaccaatcctggttgcaaatcgggaacgacctgcctgcgcaacttcgacgactcgtctacgcgatcgataccggatggccgcacgacgccaaacgtttcgcagcagatcggtcaatcgtagaggcgtactgcgcgcggtgctcgcgtagcaatgcggagtggaaggacgcggtcgtggcacacggcttcgcgtacgaccgccacggaggccgttccagttggacagcggccgctgagaacccaccgagccgaatggcagctcgggggcgatcacggccctgacgaagcaacagcgaagcaatcccagacctgaactaacgctgactaactgacagttcacatctcgacttacgcccttcaaccatccgtcgataccgtcaccgcctcccatgcccggatttcctcgtccagcgccgcgagtttgccgcgcacgagccgcagcgcatcgctgccgagcagcagatgggccggcggatgttgtgccgcaacgacggcgagtatcgcccgcgccgctttcaccggatcacccggttgcttgccgctcctctcctcgcgcgcctggcgaatcgggtcgaagatcgcgtcgtaatcggcgatcgagcgcggcgtgcgcatcatcgaccggccggcccagtcggtgcggaacgaacccggcgccacggccgtcaccgcgatgccgaacggctcaagttccttgccgaccgattcggaaatcccttccagcgcgaacttgctgccgcagtagtaagcgatgcccggcatcgtgatgtggccgcccatcgacgtgatgttgaggatgcgcccgcgccgccgttcgcgcatgaacgggacgaccgccttcatcatcgccaccgcgccgaatacgttcacgtcgaactgccggcgcatctccgcgagcggcgcttcttccatgatcccttcgtgcccgtagccggcgttgttcacgagcacgtcgacgggcccgacgttcgcctcgatttcggccacgacaccgtcgatgcgatcgaaatcggtcacgtcgagcacccgcgcgaatgcccgcgcggacagcgcttcgaaagcctgcgccgcctgcgcgcttctcacggtgccgaccaccgtgtgacccgccgcgagcgcctcctgcgcgagcgcgcggccgaagccgctgctgacgccggtaatgagcatgaggtttgcggatgccatgtgagcttctcccgtatgtcgattggagcgtgcatactagtctgacgaaccccgtcgaataagcccgattccgctgattttcttgcacaaaactatgagcctcgagcccgcctccgcccgatccccatcgctgccgccgcgcgaccggaagcgcctggtgacgctgctgcgcgcgctggcgcccgacgaaggctacaacctgacggcattgcctagcgttcgcatcctgcggtcgaaccgcgcgctgtcgcgcacgccggtgctgtacgacccgggcatcgtgatcgtgtgccagggctgcaagcgcggctacttcggcggcgagcgctatctgtacgacgagcatcactacctggcggtgtccgtgcccgtgccgttcagcatggaaaccgacgccacgcccgagcgcccgctgctcgcgctgtatctgcacctcgatttcacgatggccgccgaactcgcggcacagatcgaccgcgaagggatcgcggagcccgtgcaggcgcccaggagcatgatgtcgacgccgatggatgcaacgatgcacgcgtcggtgctgcgtttcgtcgaggcgatgggccggccgctcgatgccgcggtgctcggcccggtgctgctgcgcgagttgtatttccgcgtgctcaccggtgcgcagggcagcgcgatgcgcagcgcgctggcgatgcgcgggcagttcggccggatcggccggtcgctgcgcgtgattcacgccgattacgcgcagccgctcgacgtgccgcaactggccgacgcagccggcatgagcgtgccgagctttcacagccacttcaaggcaatcacgcaggtatcgccgatgcagtacctgaagtcgacacgcctgcatcaggcgcggttgctgatggtgcgcgaggacctgacggcggaggcggccggctacgcggtcggttatacgagcccgtcgcagttcagccgcgaattcaaacgcctgttcggcctgacgccggcgaaggaaacgcagcgcatgcgcgagagcttcgccattccggcggcattcgacgatgcggtgttcgtgtcttcacattgaatcgggtaccgcgccaggcccgcgcgccaatttccgtcgaccgcatctagctccgctgccgatagatgcgcgcgacgctcgcgaagaacgacagcgcggcgatcgcgcaggccaatgcgaacacgtagacgggaaattgccgctcgccctcgcctccgcccgcgccactgacgagcgcgatcaccacggcaaccagcgcggcgccgatggactgacctgtcgttctcgcggtcgacagcacgccggaagcggtggccgtgcggttcttcgccgcgttggcgaacatctccttgttgttcggcggcaggaagaagccgtaccccacgccgcacagtgcgacgcgccacatgaaatccccggcggatggttgcgcgggcaacaggatcagcgaaccgatcccgagacaaaacatcagcacgccgacactcgacagctgcgtcgcattgaaacgattcgccagtcgcccggcaaacggcgcgcacagcgcgaccgcgatcggccagggcgtaaagaccagcgccgatttcagcacgccgtacgcatacgtgtgctgcagcacgaacggcaacgcgaccagcgccatgccctgcgacacgaacatcgtcacggacgtcagcaccgcgaacgtgtatcggcgcgaccggaaaatgtccagcggcaacagcggatgccgcgccctggcctgcccgacgcagaatgcgagcatcagcacggccgcagcgacggcaagcacgagcacggtacggttgctccaccgcccgatctggtcgacggcgagcgcaaggaggccgaatgccgcggcggaagtcaccgcgcccggcacgtcgaagccgcgctcccgatgcgtgtcttttcccagcgcgacgaacgagaacgcgatcgcggcgatcccgaacgggaggttgatgaagaacagccagggccacgatgcccacgagacgatcaagccgcccaatgcagggccgacggcggtccccaccgcaaataccagcgcattgacaccgaagatcgtcccgagcgaggcgggcgggaaaatcacccggtagagaccgtagccgacgctgatcaggatcgcgtagctgatgccctgcaggacccgcatcgccaccagcgcgccgaaggtggacgccagcccgcagccgagcgacgcgatcgtaaacaacaccagcccgatcgtgtaaaagcgtcgctcgccgattctcgagccgagcgacgcgcacgtcagcatcgtcgccgcactcgccacctgatacccgttcgcgacccagatgaccgacgccgcgctcacgcgcaggtcggtcgagatcgtcggcagcgcgatattgacgatcgcgctgtcgagcgcggacatgaatacgccgaccagaatcgcgacggccgcaaaatagcggcgagggatgtcgaatccttcgtcgccgaacgtttccgcgatctccatgaatcacccttgccggacgcaggcccggtgcatgaactagtcgcggcgcgccggcgcgccgtgcgcggcatcgcgtgccaggcccgccagcgaattcaggatgaaggccgtcacgccccagatgtcctgcgtctgctccgcccaataccacgcgcccatgcgttcgccgtccgtgtactgacgcggcagatccggattcagcagcgcggcgaacggaaactcgaagatttccgcgacttccgcgggcgccgcctcccatgtcgccgtttccggcacgatgccgatcacgggaaagatcgcgtggtggcgctttctggttttatggatcggcaaactgccgaccacgcggaccgcgccgggcgcgaggcggatctcttcgaacgcctcgcgcaacgcggtcgcgccgatatcgcggtcggcctccgccggacggccgcccggaaagctcacgtgcgacgagtattcgctgagattcgacgcgcgccgggtcaacaggatcgtcggttcgcgccgcgcgacgatcgcgaccagcaccgctgagaatttccactgtccgtcgttgtccgcgaggaattgcttcgccgtcggccagtcggtgccggcaggaatgccgtgaccttcgacaccacggacgatcgcttccaacgcggcctgcggcgagccggcttccgcgtgcgcgcctgccaacccggcgccggcgttcacgacgcctctgtctggttccatgtctgcctcctgcgtgcggcacctgcacacgctgcacgacactgaacccgacacgtgttgcatgggcgcggcgtcgttgtggtcaatccgatgaaccggtgttcgcatgcgatcgcaaatgacacgcgcgggtgcgcgactgcgtgctccggcgtaaaaatatccgccagcgttgcggatgattgaatgccgaaacccgatcgccgtcgatcaacggagaaaccgatcatgcacgaaaaagcgagactccgttcgaccgcgcgcgcacgtcgcgtcctcgctcaagcgacggatgtcggctcgctccgcgcatcgatgcgcgccgatgcggtaccgatccacccggccgccgcgatggccgctgccgtcacgatcatcatcgcgccccacccgacccgcgcgttgagcagcccggccgcgacggcaccgccggcaccggccgcgtagtacagcgtcaggtacgctgcgctcaaggccccggcgcgggccggctgaatcgcaacgacgcgcgtctggttcgcgacctgcgcggcaaagcaaccggcatcgaacaacgccagcccggcagccagccatccgggacgaccgagcgcaacggcaaggagcaaggtcgacacggccgccgcgacaaggccgccccggatgaccgcgcgatcgccgaatcgatcggcgagttttccggcaacgcgcgtcacgccgaggcccagcacgcccgcgagactgtatgcaccgatcgcggcggcacccaggttatacggcggcccggccagacgaagcgcgagccccacccagaccaggttgaacgcgaagaaccagagcatgccggcgcaggtacgacgcctcaacggcgcactgtcgcgcagcaaccgcggaatcgcggcgatcgggtttgcacggccgggcagcccttccggccggccgcccggcaacagcaccgcaccgccgacggcggccagcgcaacgcatccggccagcacgagcaatgcgccgcgccatccgcaccattgcgacaacacgccgcccgcgaaacggctcagcaggatcccggcggaaatgcccgccgacacggcccccatcgccacgccgcgccgttgcggatccgcgtgctttccggcgacggcgctgcattgcgccgcgaccgtggttgccgcgcccaccaagaaaaacgcggcatcgagcacgagcggcccgggcgacaacgacgcgcacgcgagcaacagcgcgagcgcgcccatctgcatcgagacgagcacgcgcgggctgaagcggtcgaccagcggcaccagcacggcgaggccgaccagataaccgagcatcgtcactgaggcgagcgccgccatgcgcgacgccgccaccccgaagtcgctcgcgatcgccgacagcgacggctgcaacgcatagccgttggcgatcgccacgccggccgccagcgcaagcacggccgtcgcggtgcgggacagcggcccgcggttgccggcgtcggtcatgccgcgggcctgaccgcgatcgcctcgacttcgaccaggatctccggatcgacgaacggaagcgcatgcaccagcgaaaacgccggccggatatcgccgtagatctccccgtgcgcgcgtgcggcggcttcccagttgtcgaagtccgcgaccaccaggcggctctggacgacgtcggacaacgagaacccgctgtccgccagcacccggtcgatcgtcgccagcgcatcgcgtgtctgcgcatacacgtccgcgcctttgccggccgtccccgaaatgtagatggtgttgtcgacgaccaccgcgcgcgagtagccgaccttgggctcccacggggagccggtgctgatccgttttcgcatgttgaagatctctccagtcaggttgagaagcatcgcctactacttgggtagtaagttcgagcgattgtatactactccagtagttaatcaagcaggcccatgcaagtcgccgtgggcgcaagagccggagccgatacacatgagcgaaaacacggagctgatcacgtcgttgatccggcttggattcacccagtacgaagcgcaggcctacgcagccctcgtcgggcaggccgcgctgacgggggcggaagtcggccggcgcgccggcatgccgccttcgaagatctatgaaacgctggggcgtctggaggcgcgcggtgcggtgctcgtcaaccgttccgagcccgtccgctatgcggccgtgccccaccggtcgttgctcgaggatttgcgcaagcgcttcaatgcggatctcgaaacggccgcgggcgcgctcgaccggctgccggttcaacaggagccggggctcgtctggtcgttgagcgggcgggaagcgatcgccagcgccttcgcgcgcgtcatcgtcaacgcgaaaacgcagatcttcgcgggcgtctgggacgaagagatcgacgacctcgggccgctgctcgaggccgccgcggcacgcggcgtcgacacgcacgtggcgatttacggcaatcgcacgctcaacgggccgcgccactacgacatggccaaatgcggcgccagcgcgcggctcaggctgtccggccgccggctcgccgtcgccgtggcggacaacaccgaggccgtggtggcggaattcggcgatcattcgcccgatcacgccaccttgacgaccaacccggtcattgcgctgctcgcggtcgagtacatcaaggcggacgtgagcgggcgcgtgttgatcgacgcaatgagcccggcggagtaccggaaagtcctgaagcatcccgacatgcaggcgatgcttgcgccgctcgacaaggcgacctgacccaggcgaccctgcacggctgcccgcgcatcgcgcggcgcgcactccacccaggtacgtgaatcaccccactgacgcgagcgtccaatgaccgcctatgccttccgcctgctgaacgtattcgccgaatcgacgttcggcggcaacccgctttgcgtattcgaggatgcgcgcggcatggacgacgcgaccatgcaggcgctcgccgtgcagttcaacctgtccgaaacgaccttcgtgctgccgtcggagcgcgcgcatgcgcgggttcgcatcttcacgccgggctacgagatggcctttgccggccacccgacgctcggcaccgcgcatgtcgtgcgcgaccttctgggcgcgggcaacgaactcgcgctcgaattcaaggccggcgtggtcgacgtcggcgcgcacgacgacgtgtggacgtttaccgcgccgcatgccggcatgccgaagacggcggcttgcgagttgtccgatgcccggacggcggccctgctggggctgacggaaggcgacctgctcgccccgccaatctgggtcgataccggcgccgaccagttgctcgtcgcgctgaaggaccccgccgccgtgcgccgcgcgcagcccgacagcgcgggcatcggcatctggccgaccagcagcctcggccgcaagaccgcgtatgtattcgcgttcgatgccgagcgtccgggcacggtggtgtcgcgttacttcttcgtgaaacaaggcagcgtgtcggaagacccggggacgggatcggcctgcgcgaacctgggcgggtggctgcttgcgatgaaccgcgacctgcccgccgtgtttcaggtcgagcaaggcgaagccgtcggtcggccttgcctgctgcgattgtcggtcagtggaaagggcaagatcggtgtcggcgggcgcgtggtcgaactcgggcgcggcgtcgtcaacgtgtagacgcgccgggcggaaatatcgccgcgatcgtcagcatcgcgctgcgcgcgggcaacccgttgcgatgacgaaccggccgccaccgtccggccaccgccggatcggaaatgcggtgcggccgccccgcccgccacgccgcgatatgccggcgacaagatccgcggctatcgccggatcgatacgcagcaagcacggcacacgccgccgcgtttgttatgctgcgcgcatcgccagcccgagccgattgccgctcatgaacgccctcgcccccgacctcgtccgcacgctgcacgcctcctgcgatgcctgcttcggcacgaccgccgtctggccgctcgtcgagcacgcgtatggcgagccgcaacgccactaccacacgctcgcgcacctggccgagctgttcgcgcatctcgcaccgtatcgcgcggaaccgctgtggccggtgatcgagcttgcggtatgggcgcacgacttcgtgtatgcgacgaccctgtcggatcatgcggacaacgaagcacgcagcgcgcaatggcttgtgcaggtcacgaacgcacactgcagcgcatcctggttgcgtgcgcacgcatcgcatgtgtccgttgcgcacgatctcgtactcgcgacgaagtcgcaccggctgcccgatgcgttcgcgtccgcccccgacctccagcgtgccgggcggattttctcgacgcggatctcgcgatcctcgcggccgcgcccgatcgactgcgcgaatacgatcgcgcaatcgcatgcgagtgggcgcaggatcccgatgcgccgtcggctgcattccgcgagggccgcaagcaggcgctcgaacatctgcgcgcgcaggccccgctgtttcaatcgacggaattcgcgccgctcacaccgctcgcgcagcgcaatctcgatacgctgatcgccgagtacgcgtaagcgccgggcaagaacacgcgtaagcgcccgcataaccaccgccggatcggtcgagccggcccgtcacgcccggcgaccctccccacacccgaacggcattcctgctgcggtgctccgcggcgcggggccctgccgcgtcgaattcatccgacatccgacggcaaaaccggccaatacgtcgatttcccgggaagcccccatccacatcgcgcgtcgagcgtaacccttcaaacatcatgtgattgcattttcacaatcaatgtgattttattatcatatcgtgcatgccgccgccgaccacccacgcggcgcaccccataccaaggaagagacgcagatggagacaatcgccgttatcggcagcaacatggtcgacctcgtgacctacgtcgcacgcatgcccgcccggggcgaaacgctcgaggcgccgaatttcgaactgggctgcggcggcaagggcgcgaaccaggcggtcgcggccgcccgcctcggcgcgcgcgtcgtgatggtcacgaaggtcggcgacgacgtgttcgccgacaacacgatctgcaacttcgcgcgcgaaggcatcgacaccacgcacgtgcgcaaggtcgccggcgtgccgagcggcgtcgcgccgatcttcgtcgagcccgattcgagcaacagcatcctgatcgtcaagggcgccaaccgccacctgacgcctgccgacatcgacgcggccgcgccgcagctcgccgaatgcgcactgatcgtgctgcagctcgagatcgagctcgacaccgtttatcacgcgatcgaattcggcgcacgccacggcatcccggtgctgctgaaccccgcgcccgcggtcgccgatctcgatttcgagcggatccgcaccgtcgaattcttcgtgccgaacgaaaccgagctcgcgatcgtgtcgggcatgccggtcgattcgcgcgacaccgcggcacgcgccgccgaagcgctggtcgcgcgcgggctgaagcacgtgctcgtcacgctcggcagcgacggttcgctgctggtctcgcgcgacggcgtgcggcacgtgcccggcgtgccggtcgacgcgcgcgacacgacgggcgccggcgacgcatacatcggctgcttcgcgcgctgctacgccgcatcgcgcaacgcgctcgacgcgatgcgttacgcgtccgcgtacgccgcgcattcggtcacgggcctcggcacgcagaagtcgtacgccgacaccgcgacgttcgaacgcttcctccgcgacgccggcatctgaacggcgccttcatcgacgagacaaccaggaaggagacacccatgggccgagccagaatcgaacacacacccgacggctattacctgaaccgcacgccgctcttcgccttcacgctgctgtgctgcctgttcgcgctgtggggcaccgccgcgaacctgaacgacgtgctgatcgcgcagttcaagaagtcgttcttcctgtccgatttcgaatcggcgttcgtgcagtccgcgttctatctcggctacttcttcctcgcgattccggccgcgaccgtcgtgaagaagttcagctacaagacgacgatcctggtcggcctgctgctctacacgaccggctgcctgctgttcttcccggccgcgtcgatggcgaagtacgggatgttcctcgtcgcgctgttcgtgatcgcggcgggcctgtcgttcctcgaaaccgcgtcgaactcgtattcgacgctgatgggcccgcgcgaaaccagcacgcggcggctgaacatctcgcagacgttctatccgttcggcgcgatggccggcgtctacatgggcagcttcctgatcttcaaggaaggcgatgcgtcgcacgcgcagcttgccgcgatgtcggcggccgaagcccacgtgcaccagctcgcgatgatccaggccacgctcgagccgtacaagtggctgatcgtcgtgctcgtcgccgtgttcatcgtgttcgcgctcacgccctacccggcctgcaagggcaacggccccggcgcggccacgcaccggatcgacgcgcgcggcacgctcgcgcgcctgttcggcaaccggcgcttcgtcgcgggcgttgtcgcgcagttcctgtacgtcggcgcgcaggtgggcgtgtggagcttcacgatccggctcgcgatgcagatcggcggcctcaccgagcgcggcgcgtcgcactacctgctcgcgacgttcttcgcgttctttgtcggcaagctggtcgccacgctcgcgatgaagcgcgtcggcccggccaaggtgctgatcgtctacggcatcctgtgcatcgcgctgctcgcatacacgatcagcgtgcacaacatcacggccgtctatgcggccgtgggcgtgagcgtgttcctcggcccgtgctggccgaccatctacggcctcacgatcgacgggctcggcaaggacaccgaatacggcggctcgatcctcgtgatgagcatcgtcggcggcgcggtcgtgccgctgatccaggggctgatctccgaccacacgggcggcaacatgcagctcgcgttcgtcgtgccgctcgcctgcttcgtcgtgatcgtctactacggcttctactgcctgcgccacctgccggccgcgacgcccgacgcaaccgccgacggccacgcagccgcgcgctacgccgccacgcgcaacacgtcgggagcatgagcatgcgaggcgaaatcgaactgcggcgcgacgacttccgcgacacgccgcgcacgctgtaccgcaccgacggcctgaccgtcaccgcgttcgcgtatccgtccggcgtcgaggcgctgaagctcgagaaccggcgcggccatctcgtcgtgctgccgtatctcggccagatgatctgggccgccgcgttcgacggccgcgacctgacgatgaagcacatgttccggcaaccgaaacgcgcggcttcgatcattgatacctacggctgcttcatgttccacagcgggctgctgcgcaacggctgcccggggccggacgacacgcacgcgctgcatggcgagatgccgtgcgcgccgatggaccgcgcgagcctggtcatcggtgcggacgcgcgcggtgcgttcgtcgaagtgaccggcgagtacgaatacgtgcagggtttcggcagccactacatggcgcgtccgtcggtgcggctcacggagcacgacgcacagatgacgatctcgatggacgtgacgaatctcggcggcgcgccgatggacctgatgtatatggcgcacctgaactacgcgtacgtgcccggcggccgtttcgtgcagtcgctgccgcacaacgggctgcggctgcgcgacagcgtgcccgcgcacgtgaagccgaccgccgcatggcgcgactacacggccacgctcgcgcgcgaaccgcaacggcttcacacgctcgatgcgcccgcgctgtacgacccggagatcgtgttcttcatgaacgatgcggaaacggatgccggcggcgtcgcgcatttccggctcgcgcatccggacggcggcgcattccacactgcgtaccgccccgagcaattcccgcacgcgacgcgctggatcctgcacaacgcggaccagcaggtcgccgcattcgcgctgccgtcgacctgcgagccggagggttatcaggccgaacgccgcaagggccatgtcgcgacactcgcgccgggcgcgacgcgccgcttcgaggtcgtcaccggctacctgagcgcggcggaagcccgccatgcctgaggcgatgcaaagcgcgatgcccgcgcgcgcggcgtcaggtcacgagcgcgatcccgtgttcgcggatcgtcgtttcgtagcggccgctcagttgcccgtccgagatcacgtagttgaagtcggtcagctcggcgaaataggccgcgcgcacttcgtcgaacttcgtatggtcgacgagcaggaagcggttctgcgcgcgttccatcaccttcttcttcgcgtcgacttcgtggaagttgaagcaggtcacaccgcagcggtcgctcacgccggccgcggagatgaacgccttcgacacgcgcaccgtatcgaggatgcccgtctcggccaccgactcgaacaccatgttcttgcggtggtacgcaccgccgcacaggatcacgctgcaatgcggcttctgctgcagcttcgcgaacacgttcagcgaattgcagacggcggtgaattcgaggtcgtccggaatgaagtcgacgacgaacggcgtggtcgagccgcagtcgacgaagatcgtgtcgccggtcgtcacgaactgcgcggccagcttgccgatgcggcgcttctcctcggtctgccggtcgttctcggcgctgaccacgtactcgccgatgtcgctgcgctgcgcggcgaagtggcgggtcacgtagccgccgatcaggctgaggccgtgcgggttgtccgcgagatcgcggcggatcgtcatttccgatacgccgaacagctcggcgacttccttcagatgaatcgcgttctgcccttgcagcacgttcatcagcgtcttgattcgttcgcccttcttcgtttccatgccagtatcctgcgtgcgcgccgcgtccgtcgcttgtcgtgccgggcgcgcgggcccggccggaatgtcgtatttgtaacaaaccgatgtgaaaacatcaactttccgtgtgcccttccggcacacgatccgtggagtcctgaaacatgccgctttccaacgcccaactcgctcaaaccatcgatcacacgctgctcgcgcccgacgcgagcgacgcgcagatccgcgacctctgccgccaggcggccgagcatcgcttttactcggtctgcgtgaattcggcgaacgtgccgctcgccgcgcgcgagctgaccgataccggcgtgctcgtctgcgccgtggtgggttttccgctcggcgcggggctgtcggccgccaaggcattcgaagccaccgccgcgatcgcggcgggcgccggcgagatcgacatggtgatcaacatcggcgcgctgaagagcggccgcgccgacgacgtgaaggccgacatcgaagccgtgcaccgtgcctgcggtgcggtgccgctcaaggtgatcctcgaaacggggctgctgaccgacgacgagaaggtgcgcgtgtgcgagatgtgccgcgatctcggcgtcgcgttcgtgaagacgtcgaccgggttcggccacggcggcgcgacgctcgcggatgtcgcgctgatgcgccgcacggtcggccccgtgctcggcgtgaaggcatcgggcggcgtgcgcgaccgcgcggccgcgctggcgatgatcgaggccggcgcgacgcggctcggcacgagttcggggtggcgatcgtcaccgatcagggcggcgtcgaatcggcgtattgacgacgcgggccaccgacggctgcggtggtgcgagcgcggtggtgcgcctcgtgccgccgccgctgctaccgcgcgcgttgtcgatcctcttcagcggctttgcagtcggcatggccgtcgcgtcgtcgatccggttccatgcatgtaccgaacggcttcagatcgatggagcatccgtggcccgtatcgcgttgtcctgttgcccggcggccggccataaaataacttagttagccgaatcatctgcgataaacaacgatcacctatcactcaattagagagattcaattggcatcgcgcatgtcgacgagactacagttcggcggggtcttcccgaatttcatccaaggaacctcatcgatatgtcaaacaccgcgaatcgcttcttgcagagcatgattgccgcggcctgcgtcgcattggcctcttcctcacacgctgccgaactgacgcgcgacaacggctcgcccgtcggcgacaaccagaattcgcagacagccgggccgaacgggccggtgctcctgcaagactcgcatctcatcgaaaaactccagcgcttcgatcgcgaacgcatccccgagcgtgtcgtgcatgcccgcggcaccggcgcgttcggcgaattcgtgccgagcgccgacatcagcgacctgacgacggccaaggtcttcacgcccggcacgaaaacgcccgtattcgtccgcttctcgaccgtgatgggttatcgcggctcgcccgagcaggcgcgcgatccgcgcgggttcgccgtgaagttctatacggaacagggcaactgggatctggtcggaatcaacctgccgatcttcttcatccgcgacgcgatcaagttccctgacttcgtccatgcgaacaagccgagcgcggtcaccggcgtgcaggatgcgaacctcgcgttcgatttcttcgcgcacgcgcccgaagcaaccagcatgctgacccggctgtactcgatcgagggcatgcccgattcgtaccggaacatggacggctacggcgtgcacgcattcaagttcgtcaacgccgacggcaagtacacgtacgtgaagttccactggaaaagcgcgcagggatgcacgggctgcgcccgaaggacattcccggctcgatcggtgccgactggaacctgatgacgaacgatctgtacggcgcactgaaggcgggcaacgcaccgaagtgggatctctacatccaggtgctgaagccgtccgagctcgacgcgttcgacttcaacccgctcgacgacaccaaggtatggaccggcgtgccggagcgcaagatcggcacgctgacgctgaaccgcgtgccggacaactacttcgagtcgaccgaggaatccgcctttgccccgtcgcggatggtgccgggcatcgagccgtcggaagaccggatgctgcagggccggatgttctcgtacgccgatacgcagatgtaccgcctcggcgcgaacttcaaccagttgccgatcaaccgtccgcgcgtgcccgtcacgaacaacaaccaggacggcgcgatgaacttcggcgaccgcaagggcgaagtgaactacgagccgtcggcgttgaacgaactcgcgcagaatccgcgttacaagtcggtccagacgccgcttgccggcacgacgcaacaagtcgcgatccgcaagacgctgaacttccggcaggcgggcgagtactaccgcacgctgcccgcgcaggagcggcaggatctggtgaccgcgttgtcgggtgacctgaaccacgtgacgaacgacgcgaacaagtacgcgatgctgtcgtacttctacaaggccgatgcggactacgggacgcgcctggcgcgtgccacgcacgccgacctgacccgcgtgaaatcgctcgccgacaaactcgtcgagaactgatcgggcaatcccgcgaaggctgccggtgcggccttcgcgtcccgacccaccgatccgattgcgccgcgcggccacgcgcggcgcgcattgctgatgaagaatcgactcgaaccgccctctcccgcgcgctcgcgatcgccggagccgccgtgctcgcggcctgcgcacaaaccgcaccgcccgcagccgtgccgcaccccgatgcgcacgccgacctgcgccgctatgacgacgcatggtttgccgccgcgcgcctcggtcgcatcgacatcctgcaggcactcgtcgacgcgcgctatccgatcgacgcaacgacacgcgaaggttatacggcggtcatcctggccgcctatcgcgaccagcccgcaacgctcgactatctgctgcgcaacggcgcggacccgtgcctcggcgatcgtcacggcaacacggccctgatgggcgcgttgttcaagggcgagaccgcgatcgcgaagcggctggccgacacgcactgcccgatcgaccagaccaatcacgccggcgaaacggcgctgtcgttcgccgcgctgttcggccgcctcgacatgctgccggtactcgtcgcacatggcgcgaaccccgatcacgtcgatgcgctcggccgcaccgcactgcagaacgcgatcctgcaaggcaatgacgccgcggttgccgcactggaaaaggttggcgcgacaccgaatgccgatgtgacgttgcgctcgaggccgtgaccgctcgaccttgaacctgccgtcgagggcatgatctccgaacggcaaaggcgggcagcgaccgtttcgacgaaggcgcctcttccgcccgctccgcgacatcggcacaatgccggtcatgcgccaagacaacgccttcgtttacccgtccgccggccccgtcggccgcctcgccaaccggctcgtcgcgagccgcccgctgctgcgcgcacgccgcgcgctgctgtcgcggctgccgttcctgcaactcgcgagcgaagtcgagaacgtcgtgtactgcacctggatcgtcgatgtcgccgccgtcgcgcacctggtgccgcgcggcgtcacgctcgcgagccgcgacggccgcacgccgtttacgatcctcacctatgcgcaccgccatttcggcccgcgtatcgcgggcccgctgcgacgcatgttcccgtcgccgctgcaaagcaactggcggctttacgtcgatgcgctgccggacggcgtgccggccgatcgcacggtgctgttcgtgaagaacgtgttcgatcatccgctctatgcgctcggcagccggctcttcagcgacgcgctgccgtcgcatctcgccgcgcgcttcacccatgccgtgcaggacgggcgttatcgaacgctgctgtcaggcgggaccgggagcgcgcccgatttccactgctcggcggctgtgtcgaacgacgacacgctacccgccgcgttcgcgccgttcttcggaagctggcgcgacgccgtcgcctacctgtcgctgcagcacgcggccgtcgcgcatgtcgcggactgcgacggcctcgcccatgcgtcgatcgacctgccgatcgacatcgatgcggtccggccgctgaaaccggtcgaaccggtcggcggcggcgccttccttgaacggatcggcgcgaccggcgaaccgctgtgcttcgtcgtgccggatgttgcgttccgcgtgttgtcggagcgggtgctgtaacgccccgctcaacccgcgcgccgcgcgtgcgcgggttcgtccgcgtcgcgttcgtccgccagccgcccgaggtaatcccgcacgaactgcccggcaatccgccccgaccgcgcaccgcgctccagcgcccactgcagcgccggttcgcgcgccgcgcggatctgctccgcatcgaacccggcttcgccgagccggctttcgacgacggccaggtacgcatcctgcgtgaacccgtagaacgtcacccagatcccgaagcgctcggacaacgaaatccgctcctcgaccgcgtcgcccggatgcagctcgccgttctccgcgcgcgacacgttcgcgttgtcgctcgcctgttcgggcatcagatggcggcgattcgacgtcgcgtacacgagcacgttcgacaggtcgctcgcgacggagccgtcgagcactgtcttgagctccttgtaaccggtctcgccggcctcgaacgacaggtcgtcgcagaacacgatgtaccgctcgggccgcgcacgcaccagctcgacgatcgccggcagatcgctcagccgctccttgccgacctcgatcagccgcagcccgtgcggcgcgaacgcgtgcaggcacgccttcacgatcgacgacttcccggtgccgcgcgcgccggtcaacagcacgtgattggccgcgaacccgcgcacgaactgccgcgtgttccgttcgacgatcgccacctgacgctcgacgttgcgcagcgcatcgaacgttatcagcgcaggcgccgcgaccggttcgagcggcgccgtgcgcggcccgccgtcgaaaccgcgccagcggaatgcgacggccgcgtcgaaatcgacggccgccggccggccggtgcccgcgagtgcctcgagcgcggtcgcgatccgttcgagctgatgcgcgagcgccggaccgtcgacggatgcgtgctcgtccggcagcgcggccatcaggttctgcatgtcgcggtcgccgctcattgccgtactccctgcgacgcactcgcgtggaacgggaaccgctgcgcgatcgccacgccgacgagcgccacgccgccgccgatcaggtgatacagccgcagcgattcgccgagcagcacgatcgcgccgccggccgtcatcaccggcagcaggttcatgaacatcgcgcagcggctcgggccgagcagccgcacgccctgcatccacaggtacggcagcacgaccgacgccagcacaccggcatacaggatcagcggcacgctcgcgcgggtcggccacgccgcctgcgcgggcaagcgcagcagcatcggcaccatgaagacgagcgcggcgagcgcctgcacgtaggtcgactgccacgccggcagcgcgccgatgcgccagcgcttgagcagcacgccgtacagcgcatacgcggccgacgcggccagcatcagcaggtcgcccgcatgcacgccgcgcgcggcgatcgtcgtcgggtgccctcggcgatcaggtagacgacgcccgcgagcgacagcaccccgccgccgatcatgccggccccggcggatcgccgagcagcagcgagctgagcgccatcgtcatcagcggcacgagcgccgtgatgatcgccatgttggtcgcgctcgtcgttttcgcggcctcgtaggacaggctctggaacagcgccatcgcgagaaaaccgagtaccgcgagcttcggcaggtgcgcgacgagcgccgcgcggttgcgccacgcggggcgcagcgtgaacacgctcatcagcgtgacggcgagcagcagccggtagaacgtgatcgccgacgggtcgatcgtcgatgccgacagcttcgacacgaccacgttgccggcccacagcgcgatcgcgcagaagggaaacagaaaaggaggcttgttcatcgcgtttgacggattaatatcgtggcagggtgcgggcgtgaatcggaacgccatcgtgcccgcccgtccaactgcctgtctcacgccaaaatgtcaggacttgtcgccaatcggacactcgagcccacccgccgcttgcgcacctgcgctacgaatcgacgccgatgcccgtgtcggcgatggcggcggcgtacccgcacggcacgtcgataccgacgcactgccatcgccgcgcgcaactgctctatgcgatcgagggcgtgatgcacgtgcagtccgagggcgcgtcgtgggttgtgccgcccacgcgcggcgtgtggctcgaagccggcctcgaccacacggtgcagatgagcggcgacgtgcagatgcgcaccgtgttcgtcgaaccgggcacggtcgagcacctgccctcgcgcagttgcgtggtggaagtgcatccgctgctgcgcgagctgatcctcgccgcggtcgacgtgccgctcgactacgcgccgggctcgcgccacgatcacctgatgcacctgctgctcgccgaggtgacggtcgcgccgctgctgccgctgtacctgccgtggccgcacgacgcacggctgcggacgatctgcgactcgctcgtcgccgcgcccgacgatccgcgcacgatcgccgaatgggccgaccggctcggcctgtcggtccgtacgctgcatcgcgcgttccggcgcgagacggggctcagcttccgccgctggcgggagcaggcgcggctgctgctcgcgctcaagcgcctcgcgcacggcgagaaggtgctgaccgtcgcgatggatcacggctacagcagccagagcgcgttctcggcgatgttcaagcggcatttcggcgtgtcgccgtcggcgttttacgcgtagcgcgcggccgtgcgcgaagggcgctaccgcgccgcgatccccgcgatgaagaacacgcatgcggcggccgacgcaaccgtgcgcacgtgattccaccgcgtccagtcgtgcacgtaacgcgtccacagcgcggcgccgtgcgcggtcgacggatcggccgcggcgagcgcatcgttgagcggcacgttgacggccatcgtcaccgcgaacatgccgaacacgtacatcacgccgcccgcgagcgccgccatcgcctccggctggccgcgatcgagcagcgcgatcacgaccagggccagcgccatcagcgtcgtgacgaggaacagcggcatgaacggcgaacgcacgatgtcgacgttgatcgcattcatcgcggccacgccggcatgcggcgcgatccgcccgagcgacgtcatcacgaacgtcgaaaacgcgaagtacacgccggccatcagcccgcagccgatggccgagccccacagcaagacgggcgtcacgaacgcgatcatgatcgtgcgctccacacgccggtcgcggccgtcgcgcgcgcatagtcggcgaagtcgcgtgccggccgcccgagcgtcgcttcgatgccgtgcgtcaccgcgctgttgcgcccgtcgagcaccacgccgaacagatcgtcgagcaacgcgacgaccggctccggtacgccggcctcgcgcaatccggccacgaacgcatcggccggaatctcgcgatagacgaccggccggccggcggcccgcgcgatttcgccgaccgcttcggcgaacgtcagcgcgcgcgggcccgtgacctcgatcacgcggttcgcgaagcgcgcatcggtgagcgcggccaccgcgacgtccgcgatgtcgtccgcatcgacgaacggctcgcgcaccgcgccggccggcagcgcgacttcgccggccagcacgccgtcgatcaggtagccctcggagaagttctggttgaaccagctcgcgcgcaccacgccccagcccacgcccgacgcctgcagcgcggcctccgccgcctgcgcgcgcggctcgccgcgcccggacagcagcacgacgcgctcgacaccgctttcccgcgccagccgcgcgaacgcagcgatcgcctccaccgcgcccacgaccgccagatcgggctggtaggtcacgtacgcggccgacacgcccgcgagcgcggcgggccacgtctcgggcgccgtccagtcgaagcggacggccgacatgcgcgacacgggtcgcgtcgcgatgccgcgcgcgcgcagccgtgcatcgacgcgggcgcccgtcttgcccgaaccgccgacgatgagggtgggaagtgccgacatgaccgtctcctttgaccaaaatgcgagaatgtctcgcgtttctaaaacacgatagactctcgcattagcaacgtcaagtttttctggaggcggcatgggccgacaaaaatcggggcaaaacgacgagcccgacgcggcggcagcagcatcggatacgccggcgcgcgcgcgctggtaccgacgcagcagcgcagccgcgagcggttcgagcgcattctcgcgagcgcgtcggaggtgatgatcgagaaaggctgcgatgcgttccggatgagcgacatcgtcgagcgcacgggcatctcgttcggttcgctgtaccagtacttcccggacaaggcggccgtgatcggcacgctcgcggagcgctacaacgaagccgggcacgactgcgtgcggcgcgatctcgccgcgatgaaatcgctcgacgacctgcacgccacgctcgcccgcatcacggacagctattaccggatgttcgtcgacgagccgctgatgcgcgacatctggcgggccacgcaggccgaccgcgcactgcaggcgctcgaccgggcggacggcgagtttctggcggggctgttgacggatgcactgcgggatctcgcaccggcggtgcccgacgcgcagttggcggcgttctcggaattgacgatggtgttgatcgccgcggcggtgcgacatgcgatcgagttgccgccgaaggcggcgcgcaggattctcgcgatgttcaagcaaacattgccggaaaatctttccgtgcttgacagctaggccgcgcacgaatttcataatcgggaaattctcattcccgttcattattgaatattcgacaatataattacaaaaaccaagggcgcaacgcgagaccgcggcgcctgcatccctgattctccgttcaatccgattcaaagctccgctacgctcgaaagcgcggagctttctttttgcgcaatgcaatccgcttcgtgaagcgacgcgcgtttcgcgccggtgaactccgcgacgctttattcagcgttgcggcagccagactccgccggagtcaacaaatcgcgagatgatttaccggaatagattaattaaaagatgacgatgatcaatggaatcgatttcaatcaataatcacaatcatccatcgattcttccatttacttttcaatattgcttccgctaagcttgcgccaggatttttgacgccgaccagattgatcgacgaatttcagattcaggcgaatttgaattaaaccgatcgattattgtttattttgaaaatcaaatgagacgatatcactccaccgaaaccggccagccttcatccggttgaccgggcacgccgtgcgtcgctcggcgacaggtgtctgccgccccgaccacatctctttggcatcgcgactcaggctgcgcgggccgcgcccggtcatggcgcacggcccgcgcggcaccgcaccgctatcgcgaacttcgaactcacactcttgcgagcgctgacgatggacgacttttgccgcgcgaatttgccccctgccgaggattggccgacgttcgtcttcgaattgccggggctgcagtttccgccgtttctcaattgcgccgccgcgctgctggataccgccgtcgacgagcgcggctggggcgatcgcgtggcgatcacgaccgggtcgggcatcacgtggtcgtatcgcgaattgcgcgatgccgccaaccggatcgccaacctgctcgtccatgacggggcctcgtggccggcaatcgggtgctgctgcacggcgcgaatcacccgatgctggccgccgcgtggttcggcgtggtcaaggccggcggcgtcgccgtcgcaacgatgccgaagctgcgtgcgggagaactgtcgaccatcatcgggcgggcccgggtcacgcacgtcatctgcgaagccgggctgtccgcagaactcgacgcggcgatggcgagcctgcagtggcgcggcgacgttcgacgctacgacacggacgacacgcatccgcacgcgcgctggctcgacggccattcggcggcattcgcggccgccgaaacacgcgcggacgatccctgcctgatcgcgttcacgtcgggaacgaccggggaaccgaaggcaaccgtccattttcatcgcgacgtgatggcggcctgccactgctttccgcagcacgtgctccggcccacggccgacgacgtcttctgcggatcgccgccgctcgcgttcacgttcggcctcggcgcgctgctgctgtttccggtcagcgtcggcgcgagcgtcgtgctgttgccgaaagcgggcccggaacagctgctggccgcggtcgagcggcatcgggtcagcatcctgtttacggcgccggcggcctatcgggccatgctcgaccatctcgaccagcgtgccccgtgcgacatctcgtccctgcgcaaatgcgtgtcggcgggtgaagcgctgccgccatggacgcgcgatgcgtggcagatccgcaccggcctgcacctgatcgacggcatcgggtcgaccgagatgctgcacatcttcgcgtcgacgggcgacaccggcacgaaggacggcgcgatcggcaaggcggtgcccggttaccgcgttgccgtcgtggacgagcacggccagtgcctgccgccctacgagatcggctacctggccgtgcaggggccgaccggatgccgctacctgaacgacacgcggcaacgcgactacgtcaagcacggctggaacctgacgggcgacagtgcctacctggacgaggacggctatctgttctaccaggcacgcgcggacgacatgatcatcacctccggctacacggtgtcgcccggcgaagtggagcaggcgctgctgcgccatccggatatcgccgaatgcggcgtcgtcgggcaagtcgacgaacggggcggcacgctcatctgcgcgcacgtggtgctgcgcccgggcgtcgacggctcggatgcgttgacgacgcagcttcagcagcacgtgaaaagcgtgattgcgccatacaagtgcccgcatcgcgtggcctatcaccccgccggtttgccgcgcaacgaatcgggcaaattgcggcgcgccgtgctccggcaggcgagtcatggcgcggcgcgttccctgaatcaagcagtccaaagcgaagaaatcctatgaaaattctcggcgccgcggcggccattccggccccgcgaccaccgcgcaatcctgcgcgaacgactacgcgatcaaggcggccaggcaggcgctgcaacaagccggttgcctgccgtcggaactggatctgatcgtcagcctgtcgatctccccagccggatggcggacgccccgtcgatcgcgggcccgcggctggcgcaccccgtgcagcgcgacctgcgtgcgcgacatgcggccgtgttcgacctgctcgatgcggactggacgctcgcactcgatctcgcgcaaagccattgccggcagctcggctatcggcgcgcgctcgtcgttcgcgcggaagcgctcgcggacgtcgagcaggtggccgagagcggcttcgccgacggtgcgggcgcgatcgtgctgacgccgtccggccatgaccgcgcttatgcgagccgctacgcggatctcgattccccgccgttcgcgacgctcgacgcgcttgcgccccggcgcatgaacggcagcctgtcgctggcccgcttcgaaagccggttcgatcgcgccaccggccggttcgacgccgaaccggccaatgcgagcgccgcggtcaacgcgatgctcgacgcggcgcaaagccgcatcgaccggcgtgccgccacgctgttctgcgaatcgtggctgggcggatggccgtcgatcgccaccggcgcgcgggatgctttccgcgtcgacgtcgtcaccggtccggcggagattccgaacccgttccagctgcccgcgtggctcgcgtcgcgcgtcgcagattcgatttcgttgcgtgacgatgaacggacggtgatcgccatgacactggatccgttccggccgcgcatcgcctgcagcacgatggaggtctgacggtgcacaacgtccgaatcgcaagtctcgcctgccgcctgccggcacgccaggtccccaacgacgatcccgtcttcgcgggcgtcgagcccattccggcggaatggtggcaattctggggcatcgaatcgcgccacatgatcgaccccgatgccggtgaatccgagctcgcgctggccgagcgcacggcccgcgacgccctcgcgcgtgccggcgtggaacccgccgaactcgacctggtgctgttcaacatgacgtcgccgttcgtgtcgctcgccgacggccggcgccggttcgcgccgcggctctcgcgcgctgcgcgaccggctcggcgccacgcgcgcgctcgatgccgatatcgagatggaatgcgcgagcttcgtgctgcaactgcagctcgccgccaacctcatcaagcaggggcgcgtgaaacgggcgctggtgtgctcgtcggagcgcatgtcggcggtggtcgactacacgagcaagtcgtcgacgaacttcggcgacggcgcggccgcggccgtgctcgtcgcggagccggccgaccccgacggcgccgactggctggatgccgcatatcacagcgacgccacccgctacgacctcgtgacgatgcagtggcgcaatgcgcaggccgcggccgacgacgacgcggaaaccggcgccgacaacccgttcggcgtgtatttcacgctcaagcccgaagcgcaggaggcgatctcgcgcttcatgccggtggccattcccgatatcgtcgagcgcctgctgcaccggagcggcaccggcatcgccgacatcgatgcgatggtgttccaccagccgtccgcgctgctcgtgcgctcatgggcgcagcggctcgggctcaggtccgatcagtacgtgattcgcgtggccgattgcgcgtgcctcgtgtcggccgccgtgccgttcgcgctggccgcgtcgatccggcagggcgtgatccggccgggatcgaaggtcgtgattgccggcgcgggcgccggctggggcttcggtgcgcaattgtggcgctggggcgaaaccgtcgtgtccgatgcgggcggcacggtcgccgccgtgacggaacaggagggtcaggcatgagcgcccgtctcgtcatcgccgggttcggccatgcgctgcccgagcggatcgtcggcaacgacgaagtcgccggcatgatcgacaccagcgacgcgttcattcgcgaacgcaccggcgtcgtcgcgcgacgttatctcggccccgatcagcatctggcggatctcgcctgcccggccgcggaacgcgccatggccgacgcgggcgtcacggcgcacgacgtcgacctgctgatcgtcaatacgctgtcgcccgatcatcacgatccgtcgcaggcgtgctacatccagccccggctcggcttgcgggaggtgccgtgcttcgacatccgcgcgcaatgcagcggcgggctctacgggatcgagatcgcgcgtcacttcctcgcgagcggcctgtatcgcaacgtgctgctggtctgcgccgaggcgctgtcgcggcgcatcgacacgagcaacgccgggcgcaacctgtcgatcctgctcagcgacggcgccgccgcgctgctgctgcaggcgacggacgagccggcgcgcgggctgatcgacctgacgctcggcgccaacggcacccagttcgacctgctcgccaccgaggcgcccggcgcgcggcgcccgcgcttcatcgacgcggacgacatcgcggccggccgccaccacttccggatgaaaggcgcgccgatgttcgaagacgcgacgcgccgtatcgtcgacgcatgccggcagatgctcgacaagcaccggctgacgatcggcgatatcggcctggtcgtgccgcaccagccgaacctgcgcatcctcgacgcggtcatcgagcggctcgggctgccccgcgagcgctgcatgatttccgtcgatcaactgggcaacatggcgagcgcggcgtttccggtcgcgctctcctcgcccgcgagcaaggccgcatgccggccggccagctcaacctcctcgtgacctacggcgctggcgcgacatgggcctgtgcgctctatcggagctgaacgacatgctgaacgcatccccgggtggatcgagccgcggctggcgctgatcggcaccgccgacgtgccgctgtacgtgatcgtcaacgacgaggccgcgacgctgatcgagggcggcctgagcggcatgacggcgctcgtatggcagcagcttcacgacctgctgcgggacttcggcggcatccggcatttgcgctactggctgatcacccactcgcactatgaccattgcagcctgctgatgacgctcaagtcgcgcatgccgtggctccatgtgtccggttcgcccgacgcgttcgatgcgttccagagcccgtcggcgtgccgcaccatccgccagctcgacgagcacgcgtcacggtcgtgggaacccgccgccggcgccgatttcaccgagttgtccgacctgccgttctacccggtcaatccgggcgcgcagctcgatatcggcgacgggatgcagatccgcacgatcgcgctgccgggccacagccgctgccagttcggctactactgcccgcagctggatatcggtttcgtgtcggatgcgctgggcgagtttcaggacgcctcccactggctgccgctggtctttcaggacctgtttgcgtaccggcactcgctggacgtcatcgaacagctgcatgcaccgcggcttgccctggggcaccacggcatcctcaccggcgagctcgcccggtcggccgcacggcatgcgcgcgcgtgcctcgatgcacgcgaggccgacgcacgcgcggttcgcggcaacgccgccgccacgcaggcactcgcccaccagtggacggcccgttacgcggcaagaagcgaaaaggtcgtgccgcgtttcctgcatctcaaaagcatgacgcacatgatcgacctgttccatcgcgccgaatagccgtatccggatgtccgccgcggcaacgcacgggcgccggccggtgcgaggcccctgctcgctgttttcattcctcttccgacgacatcatgaccactgcgaccttgccgactacgcttggcgaattgcttcagaaccgcgccgccacacgcggcgaccacaccgcctacgtgttcctgagcgggccgcccgagcaggaacgggccgaatcgatgaccttctccgagctcgacgtgcgcgcccgccgggtcgccgcgctgctgcggcagaacgcggtcgacgtcggcgaccgggtgctgctgctgtgccggccggggctcgattacgtcggcgccttcatggggtgcctgtatgcgggcgcgatcgcggtgccggcctacccgccgcgcaacaggcagcatatggtgcggatcgccggcatcgtcgaaaacgcgggcgccgacacgatcctctgttcggccgaggaccacgcgcgctgctcgacctggctcgccgataccgacgcgtccggcagcacgctgctcgacgtcggcggtgcgcaggcgctggctcccgtggattcgcccgccggcgtgcagccgtcccatatcgcgtttctgcaatacacgtcggggacgacgggcacaccgaaaggcgtgatggtgagtcacgcgaacctgatccacaacctggggctgatacgcgaatggcttgcgtatgacgagtcgagcacgatcgtcagctggctgccgccgtatcacgacatgggcctgatcggcgtgatcctgacgtcgctctacggcggcttccgcagcgtgctgatggccccggaacggttcatccagcatccgtacctgtggctgcgcgcgatcagccagtaccgcgcggacctgacgggcgcgcccgatttcgcgtaccggatgtgctgccggcggatctccgacgaacaactggcgacgctcgacctgtcgtgcctgcgggccgcgtacaacggcgccgagtcggtgcgcgccagcaccctgacggatttctcgcagcgcttcgcggcagcgggcttcgccgccgacgggttcctgccgtgctacgggctcgcggagggcacgctgtacgtcgccggccgcacggaacggcacccggtccgcacgctgtgcgtcgaccaggccgcgctccagcggcaatcggtggtgttgcgcaacgagaccctcggcgtgtcgccgcagccgctggaccgcccgggcgagcgggttctggtcggcgtgggccgcaccgacggcgaacagcaggtgatcgtgcgcgacctggaaaccaacgcgcgatgcgacgaccggaccatcggcgaaatctgcgtggccggcccgagcgtcgccgccggctactggcggctggacgagcagacgcattcgaccttccgtcacacgctggccggcgaccgcgaccaggcattcatgcgcaccggcgatctcggcttcattctggatgacgaactgtatgtcaccggccggctcaaggacatggtgatcctcgccggccgcaactactactcggaagacatcgagtacgcgctgatcgtcggcgtgccggaactggtgccgaacggctgcgcggccttcatggacgaccaggccgacgctgagcgcctgatcgtcgtggccgaagtcgagcgcacgcagcgcaagggcaatctcgacagcttcatcgacgcgattcgccaggcgatctggaaccgcctcgacatcgggccgagcaggatcgtgctggtgtcgcccggcagcgtgccgaagacatcgagcggcaaggtgcgccgcagcacgtgccgcacgcagctgcacgacggcgcgctgacgatcctcgcgcagtgggacgtcgacgccggcacgcagacgccggcacccgatcgcgggcaacccgcgcgcccggccgccggtgccgacaagccggcggccaacgatcgcgggcgcgacgacgccgccaccgtcgacgaactgaacgactggctcaggcactacgcccgcacgcggatcgattcgcgaaccatcgacgagcgacgcaccattccgccgcacgtcgtgctcgacttcggcaaccggggcctgctcggcatgccgatcgaccgctcgcatggcgggctcgggctcggccaccgcgacatggcgcgcgtgtttgcgcaactggccgcgatcgattcgacgctggctttttcgtcgccctgaacaatacgctcggcatcgtgccgatcatgcagcacgcgcagcccgcattgcgcgacgaactgctgccgagcctcgcgagcggccggatgctcgccgcattcgcgatcacggagccggccgcgggctcgcatgtccgcgcgatcgcctcccgcgcgcagcgcaccgcgtccggcgactggctggtcaccggcaccaagcgctggagcggctcgtccgcgtgggcggggatcatcaacgtgttcgcgaagcaggccgacggcacgggaatggtcggcctggcggtacgccccggcacgccgggcgtgcggatcggcgccgaagagctgacgatgggcgtgcgcggcatgatccagaattcgctgcatctggatcgggcgcggatcggcgacgcatgccggctcggcgacatcggccagggcatgtccgtggcgcagcacgcgatgaacatcgcgcgcctcggcatcgccgccgtcagcgtgggcggcatgaagcgctgtgcgcagctgatgcatcgctacggggcgcggcgcgaggtcgccaccgggctcctgctggacaatccgctgagccgcctgcgcctgggcgagttgcgcgaccgcatcgacgggctcgacgcgctggtcgagcacctggccaccgagctggaccttggcgtcacgttgcctgaagactgcctgctgatcgcgaagattctcggctccgagctgctgtcgcaatccgccgacgagctgatgcagttcctgggcggccgcggttacatcgagaccaacttcgcgccgcagatcttccgcgacgcgcgcctgacccgcatcttcgaggggccgaccgagacgctgctggttcacctcggcagccgtctgctgaacggaagcgacgagcttccgcgctatctggaaagcgcgctgggcgccggcgtgctggccacggagctgcgcgagcttggcgcccaactttcgcaggacgggctcgccaatgcggcgaaactcggcggcgccgcgcatgcagccgtctgggtcaattactggctcggcacggtcgcgcaatggggattgctgctcgcggtgaccgaacgtgcggctgcgcagcagcgcatcggtgacggcgcgctgcgctgggcgcagcgccggtacgaactcgcgatcgaggcagcgcagcggcaggtcagcctgcgatccgcactgaccacgtcggcgcaattgcacgactgggccgcgcggatcgggctcgagatcggcgcgatcgagcaaacggtcccgggtgcaagccagctcgtcgatccgttgctggacgccaatcccggcgagcacccggccaccggtatgcccgatacccccgacgcgcccgacacgccggccgacgaagacgccggttccgcaccggccccgatcgcgagcgagccggcgagcctgctcgatcgccagcaggttcatgccgtcgaacaatggctcatcgcgtggctgggcgagcgcctcaagcaccgcaagcttcgattgacgcgcgagtcgacgttcgccgagatcggcttcgactcgatcctcgccgtcgagatgacgatcgtattcagcgaggcgttcagcgtgagcgtcgatccatccgcggtctgggactacccgtccattcgcgcgctggccgcccatctcgcgccccgcactcgcggcgccgcgccggcggcggtcgtggcgcacgccgatccggatgccccttcaacctttgcagcccaaccttcgatcctgtgagaccgtccaacatgcacgcccgattcgaccttggtgattccaccaccgcgctggcccggcagctcgaacactatctcgacgcctatcccgacgaaacgcgcacgttgctcggcctgccggccggcgccgcgatcggcgtcgaggtgctcgacgaggaactgcccgtcaggctcgaacaacacacgcatgcggccacgctgcgcatcggccggcacgacgcacaacgcgtgatggcctacacgcgcagttgcaactgggccaacggcatcgtgctggtaccgacgctggcacgcctggtgtttgccggcgcgttcgacggcctgcgggccggagcgccccgcgcgatgcgcgcgttcgcggcgtcccgccagcccgacccgacccgtaacctcgggattctgtggggcgccttcaacctgctgagcctggccggctggctgaccctcgatcgcggcgacgaagacgccgaatatgcgctcacgcccgccggcgaatatgtcgtcgcgtgcgtcgagcacgcccggccgctgttcgagcaactggcgaatgcaacgtcggtgctccagcatctgcacgcactgtgtcatcgaacgcgcgtggcggccgaagacagcctgctgtatgcgcggctcgcacgggcctgcgtggcgggctggccggagcttgcgccccggccaccgacctggagcgccaggtgaacggacagctgcgcacggcgatggacggcctgctgctgggcccgacctgggtcgcgctcgacatgccggtgttcgacaggcagccggatggccagtacgtgcagtcggcgcccggcatcctcggcaagctcgacgagcagcccgccggggtcgcggtgggcgcctggacacaggcggaccctgtcgtcctggacgcggcatgggcgctgatgggcaagttcggcatggtggaaatcgaccagggaaaggtgcggctcaccgagtcgggccggattcaccgtccgatcgccgcgccttatgcggggctgcccgcgtcgtatctgcgttcgtatgcgctgctcgacgagctcctgttcggcaaccccgatccgctcgatatcgacagcgacggccacatcgatcgcgtgatgaacgtgtatgcgtcgagcggcgccggatcggggccggcgtcgcaggaaatcacgacgaagatcctgcgcgagctgttcgacgacacgccgctggatcgccagcccgccggcatcgccgacatgggctgcggcgacgggagcgcggtgaagcgcctggcggaatacgtcatcacgtcgacgcggcgcggccggcacctcgccgactatccgctgctcgtgatcggcgccgactacaacgcatccgcgcgcggccgcgccgccgccacgctatccgcgctgaaggacatccccggcgtgcaggtacgcgtgatcgccgccgacatctcccagcccgaccgctacgacgaagccctggccgacagcggcctgaccgtcacgcaaccggacggcagcgtgcgcccggcgcggttgagcgacctgctgcacaccttcatgttcctggtccacaaccgccggctgggcatccggcgcaaggacgccgccgaagcgatcctggagcgccatctccgcaccgtcgatcgggcacgcctgcgcgcggtgatcgaccagcactatgcgggggccctgacggtatcggatcaggaagcgttgccgatcgggctcgaacagatcaagcgcgcgttcaaggtcgcgtacagcgacgcggaagggctcgttcccggttacgtggcggctgcggatctgatcgatttcctgacccgctggaagcgccacgcgaagcatggctttctcatcgtggaaggacatagcccgtgggcggagaacctgtgcgcgcgggtgccgggcggcccggacacgtggttgcgcaccgagcagcttccgtcggtgttcaactggggcatgcatttcgtgtcgcgccagttcatggcgccgttcaacgaattcacgctcgcgctgaccctggccggcctgcgccccgacagcccgatttacgggcggattcatccggaaggattcccggcgcccgatctgctgagcgactatcggttcttcagtatcgcgaactacgttgccgataccggcacggatcgctagcgcggtggcggcgcgtgatgccgacgcgccgcggccctcgaacctgcactcgagggccgctcctgttccctgctccctgccctggcgggttgggcgccacgccggccggcgtccgctcacgcggcgccggcccgtgccggtcagcgcttcgccggcaccggcggctcgcccgccgtcgtcgcgttgcgtgcccagtcggcgaactcggtgtcgtagcgattgccgatgtacgcgacatggtttgcgtagccgtcgtaatcgcccacccggaagcgcgacacgatcgtgtcgacgtccgcgcgatggcgctcgaacatgaagcgcgtcgccatgtagccccaccggtacgcgcgcgtgacgtagtcgctcgacgcgtaacgcgtgccgagcacgtccgagaaccggtaagcgcccgcgcgcaccgcgtcgatcgactcctggttgtcgttccttctcgacagatactcggcaacgccttcgatccaccacacggtcggcttcgccgtgctcaccgagaagtcgcccgccatgtcgtagcggccgtcgagatagtgcgtgaactcgtgctcgaggttccacaccttgaactcgggacgcagccacgatgcctcgtgcgcgatgaagcgcgcctggttgccgggcgcggacggatcgccctcgagatacatgccgccgttgtcggtgctgatgccgtagatcaccgacgcgtatttccgatagttcgcgtagtcgtcgaaaatgacgagttcgatcgtgtcgttgcgatcgcccgcgaccggcttgcgcccggtcttcatcatccggtggaagtagtcgtcctgccgcgcgaccgccgtgcagaccgactgcagctgcggcatcgtcatgtcctgcgcgagaatgcgcacgcccgtgttgcaggcgtagcgattcgggagcaccgtgtcggacagccgcttcttgtagtcgcaggttccgtagtccgcgcagttgcccggatcaccgtagtcgaccgcttccgccgccgcgagccagagatcgctgtccgtgcccgtcatgctcgtcgacgcgagcatgtcctggatcattttcttcacgcgcggcttctgcgccggatagcggaggaagcgaaacgtttcgcgcgccgcgtcggccaactgataggcggcgctcgtgttcgacaggctcgcgcggttcgcggtgacgaagcggttgagcgtctccgggagcgtcgcgtcgctgtcgagcatcggctgcgcgccgctgcgctggtgcgcgtagaagaacaccgtgagcaaaccggtgaagccgcccgccgcactgcgttgcagcagcggcgccgccgcctgcggactcgccgcgctcacggtgtacgacgcgatgcggttcttcagcgtcggcaggtagtacgcttcgtcccgcatgttcgtgatgagcttcatcagctcgttcgcggtgctcggcgcacgcgaattgtcgcgatagagcgcatcgccctccaggctttgcttgatatacgggcgcagcgacaccgcgagattcggaatcgggttcgccatgcccgatacatcatattggtaataagcggcacgcagataaatcagcaaattgaccaggatcaaattgctcgcgtcgtattgatagatttcctgcacgaaacgactcgcgacagcgtgcacgttttcggcattgaagatctgtgcggcctgcgctttatcgaccgagaacaggccgtaatggcattcgtaatcgggaagattcgcgatgtaatcggcgagtgccgcgccgcgatactgcgtcaccaccgacatgtcatggcaatcggcgcccgacgtgctgcgcttgctgcgcgtggccggctgcttgagctgcgacggtttggtcagcgccgcgcgatcctgctcgctgagcggcaggttgtactgcgcctgctcgggcgacacgggcagattctgcggcacgcgaggcatgcgcgcctgcctgggttgcatctgctgcgccggctcggtactggccgatgcggcgccggccagtccggcgaataccgaccacacgacgacggccggccagcggcggtttttctgaagcacctcgtttatcgtcactttattttatgccggttgtttttgggcaaccaagatatagcattacatattgaaacgtcaatttaatcgatatgaaagatatcaccattaattatcttaactatttaatgatttaaatcgattccataaacaattcaatcgaccgaattgtcgaccaccgccccgctacgcatacgccgcgtgccgctcggcgccgatttcggcaaccggcgtcgtgcccaacttgcgcacgatcagcatcgcgatctccagcgactgctcgtagttcaacctcggatcgacggtcgacttgtaagcgcgggccagatcggcctcagtcaggttgcgtgcaccgcccaggcattcggtcacgtcttcccggtcagctccagatgcacgccgcccagatgcgtgccgcaggcggcatgaatgtcgaaggcagcctcgagctcggcgcgaatgttctcgaagcgccgtgtcttcacgccgcccggggtcgtttcaccgttgccgtgcatcggatcgcagcaccacaagacacgccggccctcggtcttgacggcacgcagatgcttcggcaactccgcttcgatcttcgccgcgcccatgcgcgtgatgagcgtcaagcggccggcctcgttcgcggggttcagcgcgtcgatcgtgcgcagcaacaccccatgctccgggacacatcatccggtcatctgtagccagccctgttcacggtaacgtcgagatcagattcgcggcaatctcggcggcacgctgtttttccccgtcatccagtcgcttggcgattcgcgcctcgacgatcgctgcagcagcgccatacctctccagacccggcaccgcatcgaaactcgcgcgcgaacgcgcgatccacgcggcgccgagggctcggtctctcggcagaccgttgccggtcaggaaccgcatgccgaccgcatactgcatgaacggatccccgcgcaacgcctcgttcaggctcgacagcccgtcccactggcggttggcagccgcgatcgcgctggcgggcgagtcgctccatagcgtggcagccggatcggccggcaccagccagcgctgctcgccggccgaatgccccgtgtccgtgtccgtgtccattgccggcgcgaggctgcgcagcgcaagcgcgatctcggataccgccgagccacgtcgcgccgcgcggcgatgccagtccattgcgaccgtttcgtcccggggcacaccgtcgcccgtttcgtacatcagcgcaagatcgctttccgcccactgcgatccggcagacgccgcactgttgagccacgtggacgcttccttcggatcgcgcgcgacgccgcgaccgtgcagataggcgattcccaccatccgcttcgcgtcggtgctcgtcggcgcggcacgcagtgcccatgcgaacgcttcgtagtcgtcggtgcgaccgccgagcccggtcgacagatgccacgcgagcgaaccttgcgccgacacgttcccctgctcggccgcgcggcgaaaccagtacgtcgccgcatcgaaatccaccgggacgccgtcgcccagatcgtacgcatcgccgagtgacgactgatacgccggctcgccgcgatccgcgagtttccattgccagtacgcccgctcgtccgcggcaacgaggccgctatcggccgacgcaaggacgcgcatcgcgccgacattgctgccggcggccgtatggcaccagcgcgcggcctcggccggacggcgcggcgtgccatttccatccagatacatcgcgcatagcatcgcctgcgatgcagcgtcgcccagcttcgccccgcgcgagaaccagtcgaatgcgatcgccggctgcggaccgcccgactgcccgcgccagtacaccgtgcccagcgccgaatacgcggcgggcaccttgcggctcgcgaggtcctccagccattgaagccccgtcctgcccgcgaacgacgtgtggtgctcgctcaggtagaacccggccgatacgccggcagccggatcgccggcgtcggcggcctgcttcaggtagcgcaatcccgtctgctcgtcgcgcggcacgccggctgtacccgtcaggtactgatggccgacccaccgcgccgcctcgatgttgccgtggtccgcggcaaaccggaaccactgcatcgcctgcgtccggtcgacgctcgtgccttctccacgccatgccatgttggcagccatcagggcggccgcttcgtcaccgcgatccgcgccgcgcgtggccagccgaaaggccttgcgcatatccaccggctcaccgtcgccgcgtgccgcgtaacgcgcgagattggccgccgcggcgccattgccctgcgcatcggctttttcgaaccacggtttggcggcgacgggatccgcctgcgtccccaggccgttctgcagcattgcgccgagatcgttctcggcgacagccagcccatcgtcggccgcgccctgcatccatcccaacgcggcctcttggtcgaccggaccaccgcggccgaacagatagaggttcgccaatgcgtaacgcgcccgtgtatcgccggcgagcgccgccttgcggtaccagtcgcgcgccttcgcgtcgtcgcgcggcacacccgtcccgcttccgtacaactcgccgagcctgcgctgcgcgtagatcgagccggcgcgcgccgcggccgaaatcaggctgaagccgcgctgcgcgtcgcgcggcacaccgatgcccgcgagatagaggttgcccagcaccgcctgcgcttccgtgtggttctggtccgccgccgcgcgcagccacgtcgttccctggccgacatcgcgcggcacgccgtcgccccggaccagcatcaggccgagcacgaactgtccgtccgcctggccgcccgccgcggcgcgcgacagccacgccgccgcgaccaccgggtcgcgcgccaccccgcgccccgccagcgcgaatttccccgcgttcgccgcgcccgccgccgacccgccctcggcagccttcacgaagtaccagtaggcggcagcgttgtcggccggttgcccgtcgccgtccgcgcgcatcccgccgagctggttggccgacgccgcgtcgccgtcgcgcgccgccgacgcgaaccacgcgtatgccgccgcagagttccgcggcagcgcgacaccgtcgtagtagaggtagccgagtgcgcgcctggccggcgtcgaaccgtcgctcgccgccgattcgaggatcgtcatcccgcgtttcaggtccggtcgagccgcgtagccatgcagcaccatctgtccgtagagcgcgcgggccgtcaggttgccggcctcggcttcctgccggcaaaggctgcgaatctgcgcgggtttgtccttcagcaggaggctgtcgaaccccgcgttcagcgtcactacgcatggcgtcgtgtcgtcgtggacggaaacggacccggcgcgttgcattgccggcatcgcggcaggcaacggcccgggccgaggcgcagcggcgctgccgaacccgatggtcagccccgccatcagccctgcggctccgaccgaccgtttcagcgcgggcccgacgcagttgaaccgccgcaccgccggaacgcgcggccgaggtttgcccaccggcctcatggcttcacgatcgtgacgttcttgatgatgacgtcggttctgccggcctcgtcatcgatcgtcttgctcaattcgatcccgtagtcggccagccatgcggaacgaacccgagacgtcgtcccatccttgcgtacctcgctgcagtcgagattgacggcattgccggtcaacgtcccgaagatcgtcgacgccggttcggtcttgccgatctcgcatcgccgggtcagttggccgcggctcgacggttggggcagagcgaactcgatgcgtttgccctcggccaaaggcgcgttcgccaccgcgattgccgacgcatctttcagcatgccgagccgctgtgcatcgaaacggccttgaacgctctggcccatgagttccgcgatacccgacgtcaacccgaagtaggaccagtcagtcgcgccggaaccatcgcgcgtggtcatcaattcagcgaccacgccgttattgcgcctattgacgtaggtgtcgacatacggccctgcggccttcggcgtcgtcttgttcacccattcgccgtccacgatcaagcgcgaatacggcagcggccggctaccgtccggcggcaactggctgcgaatcgcctcctgcaggcgccgctcgtcgaacacttcgtccagatacgcgtccggatcggccaacacggtctcgctcgccgacttgccgccggaaatcatcttgaagagttcgtaggtgatgcgttgctgttccggctccggaagcttgtcgatcataccgacggcaaacgcaatcgcctcgcaggacttcgacgcgccgggcttcgaaagcgacgccggcagctcgatcgtattcatgcgtgcgtcgacgtcgagcaactcggccacggtgtaatgctcatccccggacgccgtgccatcgcgattcaacaggatgtccatcatctccagcacacccttgagcgacttcgacgggagcgtcttcgccagcgccgccagatccttgccgccgatgtccggcatcgcgcagttgttccgcgatccgcgcgccatatccgccgtcacccgcagggccttcagccgcgcggccggcggcagcatcgtgtcgaccaacccgggcgagctgctgcgcagtgtcgtcaatcgcgcgagataaccgggttcctgcacgattcgggtgaaccacgcgatcaggatctgcccgttgtccgagtctggatccaccccgatctgcgcaatatatgcgcgcgcacgttcactgatctgtgcgggcgtcaggttaatgaccggattcgccgctggcgtggaaaccgccggctccgcaggcgcgctctgcacgcccaatccatatgccgttgcggtcgcgatggacagcaacaccccgaaaaggcctgtttttattttcatcttgtcgtcattcgattgcgttgatcggccgagcgcgattccgccccggactttcgcctgaaatccagcgcgcgaacgtccgggaccgtaccgatgcgccggtcgcgcgcagcttcgcgtgttgcgaccgcgttgtcaatggcgcgcgcgctcggcgacgcaccaccgcggatccggtcccgttgcgatgctgtcgtgtcggggttgccgcgcgaatgttcgggagaaccaggcaaacgctcgacggcgctcacgttgccgcgtcagctgtcttttatctttcgacggagtacggtcgacgctcatccccgcttgtgcgcgttcccagccgaacgcaccgcttctcgatgccgcacatggcgggcctgttcgacaggcacggatgatggttgcacagacgaaaccgcgtgattctcaagaattgtcaaggctcaagctgacgcagcggtctcgaaggcaacgcacctctcctgcccgcccccatgaaaaacgcgggtggcgaaccgcaccggatgaactacaccatccggcacgactcgccacccgcgctgaagacttcgcggtgccctgcttacttgctgtagtcgtacacgccgcgtcccgtcttgcgccccagccgcccggccgtcaccatctcgcgcagcagcgggcacgcgcgatacttcgggtcgccgaagtccttcacgaacacgtccatcaccgcgaggcacacgtcgaggccgacgaggtcggccagcgcgagcggcccgatcgggtggttcgcgccgagcttcatccccgcgtcgatctcctcggccgacgcgacgccttcagccagcacgaaaaacgcctcgttgatcatcggcacgagaatccggttcacgacgaagcccggcgagttacgcacgccgatcggcgacttgtcgaaacgctcggtcagctcgcgcaccgccgacgcggtcgcttcgctcgtctgcagcccgcggatgatctcgacgagcggcatcagcggcaccgggttgaagaagtgcatgccgacgaagcgcgccggatcggcgagcggcgccgcgagcgcggtgatcgagatcgacgacgtgttggtcgcgatgatcgcgtcgggccgtgcgacggcctcgatctgcttcaggatgcggcccttcagctcgacgttctcggtcgcggcttcgatcacgatatcgaccgacgcgagctgcgcgtagtcggtcgacgtcgtgatgcgcgccagcgccgcatcgcgtgcggccgcgtcgagcttgcccttcgacacgagccgctcgaggctgcccttcagcgtcgcgacgcccttctcgagcgcggcgtcgctgacgtcgatcatcacgacgttgagtcccgcaacggcggcggtctgcgcaatgccgttgcccatggttccggcgcccacgacgccgacaatttcgatggccatgaaatttcctgtgtgttcgggtgctgagcggtcgattatcagatgttctcgaagatcgccgcaatcccctggccgccgccgatacacatcgtcacgagcgcgtaacgcccgccgatgcgcttcagttcgtacagcgccttgaccgtgatcagcgcaccggtcgcgccgatcgggtgaccgagcgagatgcccgacccgttcgggttgaccttcgccggatcgaggccgagctcctgcgtgaccgcgcatgcctgggcggcgaacgcctcgttcgcctcgatcacgtcgagatcggtgatcttcaggcccgcgcgttcgagcgccttctgcgtggccggcacggggccgatgcccatgtatgccggatcgacacccgcgtgcgcatacgcgacgagccgggcgagcggcttcacgccctgcgcgcgcgcgcgtccgcgctcatcatcagcacggccgcggccgcatcgttgatgcccgatgcgttgccggccgtcaccgtgccgtcctccttcttgaacaccgggcgcagcttcgtgaaatcgtccgcgctcgcgtcgtgacgcacgtgttcgtcggtgtcgaacgcgacctcgcccttcttcgtgcggatcgagatcggcaggatctggtccttgaagcgcccttccgcgatcgcgcgcgccgcgcgacgatgcgattcgagcgccagcgcgtcctgcgcatcgcgcgagatgccgtacttcgccgcgacgttctcggcggtcacgcccatgtggatcgtctggaacgggtcgtgcagtgcgccgagcatcatgtcgacgagcttgccgtcacccatgcgctggccgaaacgcgcggccggcaccgtgtacggcgcgcggctcatgttttccgagccgccgccgatcgcgacgtcggcgtcgccgagcatgatcgtctgcgcggccgacacgatcgcctgcaggcccgaaccgcacaggcggttcacggtcagcgcgggcgtgtgctgcgcgacgccgccgtcgatcgccgcgacgcgcgcgatatacatgtcccttggttcggtgttcacgacgtggccgaacacgacgtgcccgaccgcatcgcccgacacgttcgcgcgcgacagcacctcgcgcacgactttcgccccgaggtcggtcggcgagaaatccttcaggctgccgccgaaatcaccgatcgcggtacggacaccgctcaccaccacgacttctttcgctgcattgctcatcgtctcactccggttcgttcgcgcccgcaggcgcggggatacgttgcgttacatgttcgggtaattcggcccgccaccgccttccggcgtgacccacacgatgttctgcgtcgggtccttgatgtcgcaggtcttgcagtgcacgcagttctgcgcgttgatcaccagtcgatcgctgccgtcgtcgttcttcacgaactcgtacaccgctgccgggcagaaacgtccttccggccccgcatacgtgcgcaggttcacgttcaccggcacgttcgcatccttcaaggtcaggtgcgccggctggttctcttcatggttcgtgttcgagatgaacaccgacgacagccggtcgaacgtcagcttgccgtccggcttcgggtactcgatcggctcgcactgcgacgccggcttcagcatctcgtggtccgcgtgcttgtgatgcagcgtccacggcacgttgccgcccatcaccttctgctcgagcccgaccatcagcgtaccgaggtacaggcccttggccatccactgcttgaagttgcgcgcgcggtacagctccgtgtacagccacgattgcttgaaggcatccgggtacgcgttgagctcgtccgactggcggcccgcctgcaccgcgtcgaacgcggcgtcggcggccagcatgccggtcttgatcgccgcgtggctgcccttgatccgcgatgcgttcaagaaacccgcgtcgtcgccgatcagcgcgccgcccgggaacaccgtcttcggcagcgacagcagcccgcccgccgtgatcgcgcgcgcgccgtacgacacgcgcttgccgccttcgaggaacgcacggatcgacgggtgcgtcttgtagcgctggaattcctcgaacggcgacaggtacgggttcgtgtagcccaggccgaccacgaatccgaccacgacctggttgttgtccatgtggtacaggaacgagccgccgtaggtgtccgacttcagcggccagccggccgtgtggatcacgaggcccggcttgtgcttggcgggatcgatttccacagctccttgatgccgatcccgtaagcctgcggatcggcgttcgcgtcgagcttgaacttcgcgatcagctggcggccgagatggccgcggcagccttcggcgaacagcgtgtacttcgcgtgcagttccatgccgagctggaagttctcggtcggctcgccgtccttgcccacgcccatgttgccggtcgcgacgcctttcacggagccgtcgtcgttgtagagaatctcggcggcggggaagccgggaagatctcgacgcccagcgcttcggcctgctggccgagccagcgcgtgacattacccagcgaaatcacgtagttgccgtggttctggaagttggcgggcagcgcccagttcggcgtggtgaccgcgcttttctcggacaggaacaggaagcggtcttccgtcacctcgacgtcgagcggcgcgccgcgttccttccagtcggggaacagttcggtgatcgcgcgcgggtccatcaccgcacccgacaggatgtgcgcgccgatctcggaacctttctcgagcacgcacacgccgatttcggtgcctttctcggcggccagctgcttgagccggatcgccgccgacagcccggcggggccgccgccgacgatcacgacgtcgtattccatcgattcgcgcgggccgtactgcgcgagcaagtcctgtgtggtcaaaatcctgtctcctcctgcgtcccgaccgtcagccggtcagaactggtcttccgtcaacgcgagcacgccctcgttgcccttcgtgccgacaatcgacgcctcgagcgcgcctgcctgcaccagcacctgctccgcatagaactgcgcgatcgcgatcttcgcaccgaagaacgccgggtcgctcgcgcggttcgcctgcgcggccaccagcgcacgcgccatctgccatccgcacagcaccacgcccgccagcttcaggtacggcacgctgcccgcgaacaccgcgttcggatcctgcttcgcgttcgccagcacgtaatccaccaccgacgacagcgccttcgcgcccttctccagctgcaccttcatcgatgcggccgccgcaccgtccagcttgcccagcgccgcgacagtctcgccgatttcggcgatcagcgccttcgccaccgcgccgccgtcgcgcaacgtcttgcggccgacgaggtcgttcgcctggatcgccgtcgtgccttcgtagatcgccaggatccgcgcatcgcggtaatactgcgccgcgccggtttcctcgatgaaacccatcccgccgtgcacctgcacgcccaggctcgccacgtcgttcaccatctccgtgctccagcccttcacgaccggcaccagatattcgtagattgcctgatgacgcgtccgcgtcgcctcgtccgaatggcggtgggcaatgtcgctgtgcgccgcggccacgtatgccagcgagcgcgcgccttcggtcagcgcgcgcatcgtgccgagcatccggcgcacgtccgggtgatggatgatcgtcaccgactgcttggccgatccgtccaccgggcggctctgcacgcgctccttcgcgaattccgcggccttctggtacgcgcggtcggccacgccgatcccctgcatcccgacgccgaagcgcgccgcgttcatcatgatgaacatgtattcgaggccgcggttctcttcgccgatcaggtagccgatcgcgccgccgttatcaccatattgcagcaccgccgtcgggctcgccttgatcccgagcttgtgctcgatcgatacgcaatgcacgtcgttgcgttcaccgagcgagccgtcctcgttcaccaggaacttcggcacgatgaacagcgagatgcccttcacgccttccggcgcgttcggcgtgcgtgccagcaccaggtggacgatgttgtccgccatgtcgtgctcgccccacgtgatgaagatcttcgtgccgaacaccttgtacgtgccgtcgccctgcggttcggcgcgcgaacgcaccagcgcaagatccgagcccgcctgcggctcggtcaggttcatcgtgccggtccattcgcccgagatcagcttcggcacgtagcgctgcttctgctcatcggtgccggccgtcagcagcgcctcgatcgcgccgtcggtcagcagcgggcacagcgcgaacgacaggttcgccgcgttcagcatctcgatgcacggcgtcgcgatcagcttcggcagcccctggccgtcgtattcggacggatgctgcagcccctgccagccgccttcgacgaactggcggaacgcgtcgccgaagcccggcgtcgcggtcacgacaccgtccttccagctgctcggattgcggtcgccttcgacgttcagcggcgccagcacctcgccacagaatttcgcggactcgtcgagcacggcctgcgccgtgtcgtaaccggcgtcctcgaaacccggcagttgcgcaacggcgtcgatgcccgcgagttccttcagcacgaacagcatgtccttgacgggggcgttatagctcatggtcgatgttccaaatcaggcggtgaatgaggcgcgccacggggccgatacggcaaaaccggccagctccgcgcggcgaggtgacccatcctaatgccgtgcgagccggtttccattgtcatattcggcccacctggtgacaaaatcggccacgggatgaggggcgggggcggaagcggcaggctgggtgcgggtttggccggagtcgggtttgggcgggaatgacgagctggcggctggttggacggggtgatcgggggccggattcggattcgggtggcgagcagcgggcagcgggagtatcgaagctgagcacgtcagcacggcagccagggcagaaagatgccgaaatacatcgagcacatctggcacgaacccacgctgaccggttgcgacgcgtcgatgtcattcagccctcgcgtccttgatcaaggttatgtccccaaacttccggacagtaacgccggaagcgcggaaaggctgtcgatcgcgtgcacgggagacgcgaaccgcccggaaccggactgaatgattgcccacgggccgcgccgcaagaacaccggaaccatgccggcccgccgcgccggttcgacatcgttgtcgagccggtcgccgacgtaggcaatcctggacggctcgattccgttcgtctcggcgacgatgcgttcgaaaaagcgggcatccggcttgtcgacgccccacgacgccgacgacgcaacgatgtccgccggcacgccgagtgcacggagtgcacgttcggtcgcgacgggttgatttcccgcgatgccgaccagcacgccggtttcgcgcagtcgtttcaggcacggcacgacgtcggggtagagatcttccgcggtcaccgtataagtgctcccggtcgcctctcgctcccggcacaatgcggtgaagtcgacacccggcctcacgaaatcgaacacgcgacgatgatgctgaccacgcgcgatgaccgcgccgagcaacgcatgaaacatccgtcgcggcacctcgagatggtcggcccactcgttccagtcacgactttcatcgatcagcgtttcgccgacgtcgaagaacacgacttttatcatcatcgggtggatcgggctccgcaaaaacggatcttcagggtttggcgatgccgggatgggtgggcaatgacgggagtcggccacaagctgccgctcgtctgccgaaggaagctgccattcgattggctcatccgctccaaaacctgccaaacgtcgaaggcgggtaggccggacgatagcatgccagagccagaccaacgacgagcactgagtcgatggctactaggctgcattgaaggtgtctcgcttaatatgacggtgcttatgcgaccggcctgcgttcgagtcgaaggggcgcttcgagcctcgcgcataaggccgttgaattgaaaattcggttacttggcggaaagatggttcgaatcttaaatgccgaggtcagccgtcaaccagagaagagattgcctcggtgcaatcgatacctctcgataaattaatccaggaaaataaaatacagtcttaggatcatgtcaattatgaatgaaaaaccagcttggttgaagcgctcagaaaatgggagtattggagaagcccgcgcccgggcattcttgctcgaaagattttgggtgctagaaagatccgtagacaaagatggtgcagactatcttattcaacgtcggctaacgaacgataatttttgagccgagaggcgccacgccttggcgttattcaggttaaattcttgcaagatgagaaaacgtcaatctacatcgaaccgagttatttgtgcgacgagtacggagctgcatacgctgaattctttcttctaattaattccggcgaagaagacagtcaacgtcaatttattctttctgcaaaagatataatatcgaatttcggaaaatcgagattgaaacggggattggataaatattatattaacgggacggctgtcatgtcgacatcaaaatacgaaatcctcagtagatcgagggcgcttgatcgaatcgaacatgcgctgaacaatgcggatttcacgagaaacaggatgtattttggggcatcgaccggctacataaaaatcgaaaagcatcagattgacaacgattatttgatcgatcttgataatggatactgcgacattgataaggatttttcaatcaaaagcgaaaacttcaatcgacgttaatcgatatcgagttggcggtcgaagcgatgcataaaatcatacgaacgaccgatcctttgaaggcgtttgagatatatgaagagcacattaaagatcacgtcggatccagaggaatagagttctcgttcgatttttttgatgatgaagatttttatgccgcggcgaagaatcatagggagcgattggaaaaacttcgagaacttgagttggaaaattcgtatttaaatttacttgatcgataccaagatgatgtgcttgagtggattgtggaaaacgaggcgtgggatcgcggcaaaccattgaaagtgaccgccatgtatcgtcccaaaacgctcgataaactgcaactctcgtttgagctagtggagtctcctggcaatgagcttcctgtcgtgaaatcgtcaaggcttgggctacaagttatcgttcttgatccagttcacctaacgcggaaatggggcgccccgaaggacgcaagcgcatcagaaatcgcgtcagcaaacgcttggcaagttcgacggacgtttcaacgggaagtcgacaggcatctgctaggcgaggacctggtaagtccttggatgtaacaccgttggatatattgatcagatcgctgcttaactcgtgagcaggtgaagaccggaatactctgagaagcgccattcagacgcgacaagccgaagggcggcaatgggtcgatctgcgccggtcgcgcgtcacagggcggcggccggccgcgttcggccagtttgggacgttcgcatgatcttagttgaatggtcgttttcggccagttcgtgcgaatttacccagcatccgttgatccacaatggcccgtatccgaggcttatcacttaccctggattcacgacgtttccattttcgtctcgtgcgatccaaccgtcgggttcggctgtaacgaccagctttgtgcctgggcccatggtccagtggatcggctttcctgtccagataatgttatcgccatcgaaattagagctaaaatccgtgcgatctacactaatggtgtttccttggacgttcgtaactaatatttcttccacgtagtccaattgaagacacttatcgaccacggccgttctgatcgccaaattttcggatcgactgggatggacaactgatggataactcacagccccaatgactcgatgatcaccaattaattctcccgatgacagcttttcagagatggcggatgtaatcttgtactgacttgagtacgtttcgtgaatcggttgagagaacttcgtctcaaaaatgtaaggacaatgtctctaaccaaatcgctcatgtcatcttcatcaggtggcgcgattctgttaataaaaattcctgcgagaccgaccactttgataagaatactttatcgcctggttgaactccaagctcgtagtagatggcagacggatcgacgctgcaatagaacatcggattgctgggtggattgcagcgctgaaaattggtaacgatgcttgctggtggatatcccagaaaacctacctttgatggcttttcacgaaaaacaacgcctctgtaaagccgcgagtccatgtgtggcgtcactcctctcatttttaatcctacggtgaggcgtgcaaccagatttttaatataattatattctaccttatccaagttcatacgattgagttgtccgataatacgcctcgcctcgaccgatttgatttgaacgatttctctcattatttttaccctttattcgcaaattgagtttttgaggtggtgcagcatgcaccactttttctatgctcagcgtagccgacaaattacgggcgcatgaactggtctagggaagcgctgattcaatcgttcgcatgcctcgcaaacccttgtcgatccatgctccgcgacatgaacttggactttaatcaatgttttcataggaaaatgttagtgcagtctgactataccctcaaacaagctcagtcactgaagatcagcagctaggcgttacttaaccgacttgaggtcggtgtgtgcaaaggttagtatcacttggtccaagaagcggatactcttgactcgttggtgaatgactcaaacgggtcgatttcgggcaactgcactaggctaagtgcaagcaaccccggaaggcagcagccaaccaggaacggacggtcaatgtcgtggcttgattcgttgacaccttcacggccaagttgactggatgcgccgtcagctaccttttcttcaatagggccgcgtagtagtcggcgatattgtcctccgtccccttggtgatccgattgaacacccgtccccatggccagaagctggaacctgtggtagttcgcaaacccgggaatcgactttcgccgagggtgaccataccccattcgccaccatgattgcggcgatacacctctccgacgtaacttccataggctttcgcaaatgacatgacttgctcgtccgttggcttgggactagtgctgacgtaggatgaactcatttgcgccaagatcttttcgacacttgcaatactcgcgtccgaccagtcgagttttattccaaactgtttcgcggagaagtcaacggcgtctagcgagtaggcttccgcgattttctggatttttgcatcaggagaaaaggtctggccggacgaggtttctgccaacgcaactccaccgcgaacgcaagccatcagggcgatcagcgcgaacaggaagcgctttacgattgttttcaagaggattcccactctaagataactctgactcgctccagtgagtcagagtgttgaatgatcgcctcgaccgatctcatacgccggagcggcctataagcaatgtgaacggcagctttcggcaaatctgaaggtccccttcgggtcggcatcaacccgtccgacaccaccccgatgccattcgaccggggccggccagccgcaggcatcggccggctgcatcgcctggacattcgaacgtccaagcgccgaggagacggctttcgcgcgaattccgtatccatcgggcgatggcacttccagatagtcgcgggctgtgatcaaaggctgcccggggccgccgtccgaatgtctgtacgccaaggtgcagaacaatcgcgcactccctgaacccgaacgtccgaacatggctggcgcatgtactggacgcggatgcgctttcaatccgtcgccggcgcggcacctgcccaatttccgtcgttccggtcccagggaggcacgccactgaacgcgtcgaccaggaaatcgatcatgacgcgcactctggcgctcaggtgccgacggctcggatacagcgcgagaatgtcgatatccggcaagcggtaccggggcaacacatgcacgagccggccctcggcgagatccttgccgatcaggaaagtgggctgctggatcacgccgtgtccggcaagggccgctgcacgcgccgtatcgccgttgttggtatgcatgtgacagtcgaccttcaccgagtgaagcttgccgcgctcgtcgatcagttgccagtcgtcgccggtggacgcatacgtgtagccgatacagcggtgcccgcccagctccgccggggctgccggaacgccgaagcgagccagataggccggcgatgcgcacagaatgttctgcgacgtcgccagcttgcgggccgcatgactggtcgaaccggcacgtgagatgcgaatggcgagatcgtagccttcgtccacgatatcgacgacgcggtcaatcagtccgacgtcgagttcgactcccgggtatttccgcatgaactcgggccacaacggtgccagatacaaaatgccgaagctcacgggggcattgatgcgcagccgcccgcgcggctcgaccgacgccgacgagaccagcccctccgtctcggcgacatcgtcgaggatcgacttgcaacgggcgtaaagcgtctcgccgccctcggtaagagaaagcgtacgcgacgagcgattcagcaagcgcgtgccaagatgcgcctccagttcattcacatagcgtgtgacattggcgggcgacgtgccgagcgcatccgcggcgcgcgcgaaaccccacggctcaccaccgtcacgaaaacctcgaaagcgcgcagacgatccatcagctcctcgattcattcacaaaagctgaatgatagaagcacattttagatctttctatattcataactgaagcctatattgctttcaacgcgccaatgcatggggcactggccgacgaagtgcatcaggagattgaaaatgcaacgcttgaaaggaaaagtcgccatcgtcacgggcgccagcgcagggattgggcgtgctacggcaaagctgttcgcaaaggaaggcgccaaggtggtcatcgcggcgcggcgcggcggaactcgaaaccctcgccgcggagatcgtcagcgaaggcggcgaagcagcatacctggcgggtgacgtgcaatcggaagacttttcgaaggcgctggtcgcgctcgcggtgagccggttcggccgcctggacattgcctacaacaatgccggtacgctcggcgagatggggccgagcaccggtatttccgaagcaggctggaatgccgcgctgtcgaccaatctaacgagcgccttccttggcgcgaaacaccagattccggaaatggtgaagcaaggcggtgggtcgatcatcttcacgtcgacgttcgtcggttactcgttcgcgtttcccggcactgcggcctatgcggcgagcaaggcgggcctgatcggcttgacgcaggcacttgctgccgagtatggcgcgcaaggcgtgcgcgtgaacgcggtgttgcctggcgctgtcgacacggacatgtatcgcggcatgaacgacacccatgaatcgcaggcgttcgtcacgggcctgcatgcgctcaagcgcgttgcaaagccggaagagcttgcccggtcggtgctgtatctcgcttccgacgattcgtcattcgtgaccggtacggcatcactcgttgacggtggcgcgtccattacccggacctgatccctctttgtcggcatccggcttctacctgccgatgccgccagttctacctcactcatgcaaaggaaatgactcatggatctgaatctgcaaggcaaactcgcattggtcagcggcagcaccgccggcattggcttcgctatcgccaggactttggcgcaggaaggcgcgcgcgtgatcgtgaatggccgctcccagtcatcagtggatgatgtggtcgcgcaactgaaagccgagacgggcagcgacgtaacgggttttgcgggcgatctcgccacagccgcggcggctgatgaactggcaacgcgttatccggacgtggaaatcctggtcaacaacctgggtatcttcgagcccaagccatttgaggagatccccgacgccgactggtcgcgtttcttcgacgtcaatgtgttgagcggtgtacgcctcgctcgcctgtttctgcccgcgatgaagcgtgcaaactgggggcgcatcattttcatttcgagcgaaagcggcgtgcagattcccgccgaaatgatccactacggatgacgaaagccgcgcagattgccgtgtcgcgcgggctcgccgaagccgttgccggcaccggaattacagtcaatagcgtgctgccggggccgacgaaatcgcgtggcgtgggcgagttcgtggaggcgcttgcaagcgccgagggcaaatcgtttgaagcgttcgaacaggagttcttcgagaaagtccgccccacgtcactcatcaagcgatttggttcgccgcaggaggttgcgtcgctcgtggcctatatcgccagtccgctttcggcggccacaacggagctgcgttgcgggccgacggggcgttataaaagcgcctttaaaaccccggccgacattgggccgggctttcgaaagttgcctcgctcaatgtcccgatgcggttggctgaaacgctccgtttgtggcgtccgcgacaatcaggcacggggcggctgtcttgcattctcgcggcggtatcgttcatggcgtcgtgggcagcgcggtcattcagcgggcgtgatggatggcttcgcttctcgaggggcatggccgaagtaggccttgtaggcacgactgaaagcggcttccgactcgtaaccaaccgaccgtccaacctcgcccacgcgcgcgtcacctttcgccagcatgtcgcgagcgacgctcaagcgccattcattgcggtaacgcaacggcgacttgccaacgagcgcattgaaacgttcgcaaagttggagcgggacatgcccgcgacggcagcgagaccatcgatcgtcaaaccacgtggcgaccgctcatggattgccttcaaagcgcgggcaatacgcttgtccgccaatccgcccaaccagttcgatgcatgaccatgatgaacccaggcacgcaacgcacgcaccaccacgagatcaatcatgcgggagaccatcaaggcggatcccgcctcgtcattgtccgcctcatgcagaagaaactgcatgatgttcggcagccagtcgcatgtctccgcctggcgaaggtggatcatggcgggtaacgtcagaagcagatccggctggctcgccggatcgaaccagaagtggcagacgacgacgttcgccggttggtccagggcggaaatgcgcaggctgccaggtccgcgcggcaacaagagcagttcgccggaccgaatctcggaagcgtctgcgtcatcgccggcaattttcaccacgccttccatgactgcgtacgcgtgcgccgcccgcgcagacatgtccaactgcgcgaatggcagcagcatcgacgaaaagatgcggtcgcctgtcatgcgcatacgcgcaagaacctgagacaggagatcaccgttagccagaccagcaagcgcccgatccggaaaaatggtcaagtttttcccagattcagtcatgtcaattcgggtttcgtgagcctaaagtaagcgtcgaccaccaacgaaatcacgcaaggcaaggattgaaaccatgtttggaatttcgccgctcggctggatacacactcggcagtctacccgcgatccccatggccgtgtacatgttcgcgcgttacggcaggatcgttccgcgctcggttgccgggagggtgtacttcgttaccatgttgattggttccctgaccgtgttcgtcatagcgcatcaaggtatcagctacgtcatcggagtcggagccgtcgtgctgttactggctggatatggcgttgcgtatctgccgctgcccggtcgagccggtatctacctggaaaccttctgtctgacgttgaccgcattcgtgctgatggttcccacggttaccgaaacgctgaagcgtgtgcccgacggacatccgctggtcagcgatccgaggtcgccactgcttctcggtgcccaagccgcgctcctcgtcgcgctcgttctcgggctgatcgctcaagcgctttatcttcgcaggaaaccgcagggcacccgttcgatgaaaatctagagaacgggcaagaagcgacgcttccgttgccgtgtgaatacgataatagatatgtaatccgaatgatatcggcttgatgttgatctgacgtcggtggagtgatcgaagccggctcatggtatcgaaagaagatcgcgccacccattcggatcccgtgcgcttcgtgacaagccgcatactcgcgaagacagtcgaggtcacgacaagtcacctcgtgctcatttcgcatccggtagaagccgcgaacgtgaccctcgatgcgaccgccggccagcgcaacgcgggcgccggcaacaagattgcgacggtccagcccggtgttcggtccagtcaaccgctcggtgctaacggagttgggattggcgtacttcgccacgtcgacagtggtatttttcaggcgagcgcatgctaaacgaccgctttggagatctatgcgtggccgcttcgggtcgatttcgggtaactgcgctggcctacggcaagcaactgcggaaggcagcagccgaccaatttcagacgttagacgcgatcacttaattggtcgacaattgatctacctcctacttgcgcaacatgctcgggtaccgacatgaaatcgctgtccccttccgattgttcgacgtggctgaaatacgaagaatgtattgaagcgccgtacgggaaggccgggctaggccacacatcgtatttgcaattcgcagtgcgggaaaacgatggggcagcttccgtggttgtcgacggcgttcgcagctatcttgagccgccgagaacctgtttgctccaggtcacggattggtcgaggcatggagagcttgagaactcactattggaggaaatggaatcgacatgctccggcaagctaaacccgtgggacggctttggccaactcttcgaggccagcgaagcagatgacgtgcttgggtgttgcgccacagtgcttcgttgcggcatgagcgcatacatctacataccgctaagagccacatttcttctttgggaggggatcttgtcgatctttgggctagcgcatctgtggcacggaatcagtttctgcagcgcttaagaagcgaaggggtacgcattacaagcagctaaatggtgactgcacagatgtttagaggcgaatgaacgacggctatcggtcgataccactgaccgcaacgggtcggcaaccgtcggccgcatccgtcggttggcggccaaaagcggtcggtcggcaacagagtatagatcgtcgacgatctttagccgtgtgagtcgttttggcccttgggatcacctcaggcaaccggggcatgtggattgattcacaaatcaaaattaatgtgccaatatgaccggcatggaactccgtaacgtcccgaaccaatctcgtcatcatcacggtcgtcactcgatgcgccgtggttcgttacgtccatagcaggacatccgggattgcagttccccttcctgtacaaacgaccaaggcgcctatggcgcctttttattttttaccccaaggaggactctcatgaccatgattcgcggaacacgcttcatcgttggcaaggaagccgcgcaaatgcgcgctctggaaacccaattccggagctatcttcattaacgtcggagcagaggaggcgattgtcccggcgttgtggtcgcaagatacattcattcaaaaagccggtggtagcgagatcatcggccagatgtgggcctttcccgacaagaagggacgcgcttgctgcctgattcccgaggcgacggcactgttccaggagcgatgcggcgagctactgggccgacaacgggagcggatgttgttttatatcgctcgatgctaccgctatgaacgacctcaagccggtcgttaccgcgaattctcgcaactaggatttgagtatctatgccccaacccggaatccgcggtcaaacgtagccaggaggtggcgaccggctttttcgattcactcggccttcgctatgaaatcgacgattcggcccgcagaggcctcagttactatctgaacggtcggggcttcgaaatgcgctgcaccgaactcggcgcacaacagcaagtggttggtggcggtgcctatcaggagggagccggtttcggcatcggcgctgaacgactgttgttagcgatgaccgctcaggggcttgtgtagtaacgtccaatgccgacgcggcttgcggctcgggacagtcgcaagctccatatcgccggctacacatagtaaagcgatggcacgagcgtcggctctccgcaatcttgactgtcccttgcgggtcgccaacggccatccccggcccaaaccgatcccccaacccacctacttcaccgcgacaagcggcccgacaaacgcctcgaaatgcggcagccagatcggaatcgcctccttgaccgcaaacatcccgtggccgttcttgccgaacggcggctcgacgatcatctgcccgtgcccgcccgccgcctgaaacgcggcaaaccacgtcgccacgacttccggcgcgaaatacttgtcgttctgcacgtaatgccagagcaccggcacgcgcgtcgtgctcgcgaaatgcccgatcgtgtcggccatctgccgcggatcgcacggcatgccgggatgcgtcgcgggattcccgccgcgcccgcccgagaagttcaccaccgcgaccacaccctgcggcgcgtagctcgccgccgccagcgacgcgaagccgcccgccgattgcccgaccagcacgacgcggcttcgatccacctgcggcaacgtctgcgcataccgcacggccgcgagcacatcgcgcgcggcctgctggccggcagcgaggtaatcgggatgccggcacgaccccgcatcctcttcgtcgacaccgcccgtcgcaccgtacccgcgacggatcggcacgatgaccgcgaaaccgtgctgcacgaacgtccggatctgcggcaacgcgcggtagcgtcccaccttcggccgtgcgcgcggatcgggcgggctgccgtggctcagcacgatcagcggaaaaggcccggggccgttcggcatgtaggttgtggcgacgatgtcgcgtgtgctccccttcgtcgaccggcaccttgacgacggtttcatgcagatcgggggcaatggcggtgtcttcgaccgccgtcgccgcgcagccggcgacggaagcgatcaacacgcccgggatcagcgcccggcacaggggatggcgatcgggtttcggcgaacgacgatgctcatgggcaatctctccacgaatccagggatgacgggcgaggctgtggcgcgtaccgcgaaggcgacagtgtatccgtgcggcgccgcaaccgggccggccgcatgcttacagcccgcaccggccgcacacccggcaccggcatcctgatcgtcacccgccatcaccaccggtaactgacatccccgtcaccgtcagccgcgtgccgtagaagcatcctcccgccgaaaagcacgacgacacataagtccggtcgaacaggttgttcacgtgcgccgcgacgcgccaccccttccacgccggccgctcgacacctaggtcgtacgacagcccgagatcgaagagcacgacggccggcacgtcgaacgtattgacgttgtcgcccgcgctgcgcccgacgtagcgcatgccgccgcccaccctcagcccgcgcaggcccggccggtcgaccgcgtagtcgagccacagcgacgccagatggcgcggcaccgccgccacgcgcttgccaacgacggccgcgtccgtataggcctgcaccgtcgtgtcgagatacgtgtacgcggcgatcacgtccagttgcttccagacgcgcgaccgcccttccagctcgatcccgcgcgagcgcacctcgcccgtctgcacgttgaagaacggatgctcgggatcggcggtcagcacattgcgctggcgaatgtcgaacgcggcgatcgacacgttttgcaaccggtccggcgactggtagcgcagcccgaactcgaactgcttcgccttcgtcggcgtgaacggctggccgtcgaagcgcgtgccgagcgccggctcgaacgacgtcgaatagctcaggtacggcgcgaagccgctgtcgaacagataaacggcaccggcgcgcccggtgaacgcacgcgtgctctgccgcacgctcgcggagcgcagcaggtcgtcggtcgtcgtgcgcgaccattcctcgcgcccgccgagcgtgaaaacccagcgatcccagcgcacctggtcctgcaggtagacgccgatccggtcgggtgtctggcgcgtctgctgcccgatcggcggcgccgtgaacggctgcccgtaatcgggcgcacgcgtatcgagcggcggcgccgcaccgaaccccgatccgacgaggttcgccaccgcatgctcgtacgacagcccggccagcaccgtatgctcgaccggccccgtcatcacgcgcatctcggcctggttgtcgagcgcgagatggttcacgtgctcgcgcgaccacgacagcgaacggttcagcacgcccggcgccaggtagggcgcgacgaaattgacggccgcgcccgcgaagtcgacgtcgagatgcgtatagcgcacgttctgccggactttccacgtcgagtcgaaacgatgctcgaacgcgtagccgatcatcgcctgcgtgcggtcgtacgtgtcgaagccgggcagccccggatagaagcgcgtcggcatccgccggcccgcgtccggccacagcgtgccgagggccggcagccagcccgcgaagttgttgtgcggatcgcgctggaacgaacccagcagcgtgaaactcgtattggcgttcggctgccacgtcagcgacggcgcgacgacgatccgctgctgccgcgagtaatcgatctgctcgtccgcgcggcgcgcgaggccgtcgatccggtagcgccacgtgccgtcctgcgtcacgggcccgctgaaatcgaacgcaagctgcccgcgatcgcggttgccggtctgcacggcgagcaggtgctgcgcgtcgcgcgtcggccgcttgctgaccatgtcgacgatgccgccggggctcgcctgcccgtacagcaccgacgccgggccgcgcaacacgtcgatgcgttcgagcgtccacggatcgacgacgctcgcggcccagttcacgcctttcggcagcggcaggccgtcgagcatctgcggattgatcgccgccgccgcgaagccaccgaagccgcgcaggaacacgctctcgagcacgccgccggggcgcgaatccgcgtacgtgcccggcgtgtagcgcaggctgtcgccgacgctgtgcacgtcctgccggtccatctgttcgcgcgtgacgaccgacaggccctgcggcacctcgacgatcgccgtgtcggtcttggtgcccgcgcgcgacacgtcggccgcgatgccgttcacggggccgacgcccgtctcgcgccgcccgtcgacgacgatcggcgcaagcagcggcgcatccgcgggctcgcccgtctccggcccgtcctgcgcggcagccgcaacggtaatcggcatcgcggccgcacaggccagtaccgccgcccagcgcggcgcgcgccgcaacatcgtacgcggcaacggaaatccaggccgcgcacggcagccgatgtgtgatcgattcatgtcgggttatccggaaagcggagacgggcgtcggcggatacgtcgcgcccttgggtacggagacgggccgctcttgcaacggcgacctcgactgaacagcgaatgcgaatcatttacgccgacgcgacgcgggtaaatgccggtggacgcaatcgacgaatgtgcggcatgcatcgatcggccgcaggtttattcgtctgacgttaacaaaatgtcacgtttgaatgtcgttatcctgaacgaccaaatgaatgatcggatgataggatagcgacaccctcaagtttcaagcgacacacttaatgtcaagcctgccccggccacccgacactccctcgtcgattctgcgatcgagatcctcaagtccaacatcacttccggcatctggcgcgtcggccagcgcattccgaccgagctcgatctcgcgaagcagctcgaagtcgggcgcaacacggtgcgcgaggcggttcgtacgctcgcgtattccggcgtgctcgaagtgcgccagggcgacggcacctatgtgcgccgcaacgtcgatccggccgaaacgatgcgcaacgtcgatcgtgccgcgcgcagcgaccatctcgaactgcaatgcatgctcgaaacggaatgcgcgcgctacgcggcgcgccggcgcaccgacgaggatctcgtgacgctgcgcaagctgctgaaggcgcgcggcgagcgcgaagcgtcgcgcgacgtgaagaagttcgtcgagcgcgaccgcgcgtttcacatcgccgtggccgccgcctcgcacaatcacgcactcgaagcgctgtatcgctatttctcgggctcgatcctcgcgaacgtggaagacatcctcgtcgaactcgacgaggccgaaatcccgagccggacatgcgggcgcaccaggcggtgctcgacgcgatcgaacagcgcgacgagaacaaggcggtgcgcgcgacgctcgcgatcctcaagccgcagatgacctggctcgagacacgcgaggcgcccgccgcctgacgggcaccatacgcccggtacgcccggtgcgcgctacgcggcgacggcctcgatcacgtcgatctgcccgtccggcgcggagcggagccccgcgggccgccagccggcggcggcgagcagcgcgtcgtattcgtcccgcgtgcgctcgcggccgctgccccagcacatcatgtggatgtcgtagagcttcgagaaatgcgcgacgcccggcgccggcacgacccgctcgatcacgaacacgcgcgcgccgtcgcgggcgctttcgcgtgcccgcctgaggatcgccacgcattcgtcgtcgttccagtcgtgcaggatcagcttcagcaggtagacgtcggcggccggcaccgcgtcgaacatgttgccgcccgctttgctgcagcgcgcgctcacgcccatccgctgcgcccagtcgtccgcgtcgccgtcaatcacctccggcaggtcgaacacgacaccggtcagcgcgccgaaccgccgcagcaggctgcacagcatgtgcccctggccgccgccgatatcgcacgcgtgcgtgcccggcgcgaacgtgacgtcgcgcagcgcatcgacgacctgctccgactgcacggtcgagaaactcgacatcgcgcgcttgaaatcgcttcggtagcgttcgtgatccttcgcatagtcgaacgccatcgcgccgaactcgcggacgaagccgttctgctgcccctcgcgcaccatgtcgggcaggtgcgcccagatcgcgtagtgctcggggccctcctgcaacagcacgaaatcgcgcaacgtactcgcggcgtccgcgtgcagcagcgccccgacgcggtggcccggaagccgcgccgcgtgtcctcgtcgagcagcccgagcgcggcgagcgcgcgcagcagccggtacagcagcggttcgtcgacgtcgagcgtcgccgcgagcgcggccgacgaaaccggcgcatccgtcgtgaccgcatcgaacacgccgagccgcgtgcccgcatacaggatccggctgcgccaccgcccgaacagcgtatccagcacctgttttgccgcattttccataaagcactcctgaacagggttcgaccgcaccggcgcacgatgcaccgggcgatcgcatcgtcaacgaagcaggcggatcactgctcgtgcaggaattcccggatcgggtagccgacatggcgctgcgcatcgagcgtatagccgaggatgcggtcgccgcgcttgagctccgtgatgttgtgcacgctgcctttcggcccgagcacgcgcacgtgccagtcgtcctgcgcaatgatgttgatcgcgcgattcgcggcattcttcgcctcgatcagcagcagcggccgcgtctcgaccttcgcgcgcccgaccacgacgcggcgtgccttgccctgcacgttgacggcgaggatctccgcgcccgattcaagctcggcgaggtagcgggtgcggttgtccggcgcgacgacatacgaatggagcgcggccgcgttcacgcggaacgggcgcgtcggcatgtacggcagcgggtgcgtctcgctgctgatcaggatcatgccggtcgaatacgagcccacgaggatgccctcgtcctgctcgaagcgcgagcaggtgtcgacgcatacgcgctcgcccggccccaggtgcgtgagcccgacgatctcgatttcctcgagctgcagatcctcgaccgtgtcgctgcagatcgacacgagctgcgtggcctgcccgacctgcgtcggcgtgagcagcacgccttcggggccgcgctgcagcacgttcagcgtcacctccgcatcctccaggtcggcgacgacggtgatcagctcgcccgccgcgcgatcggcggccgccagcaggatctcgagcgggatcttgctcgggtcctgcaggaattcgacgagcagccacggcgtggacaccgataactcgcacgcgcgcgtgagcgtcgcctcgcccgtcacttcgatgaacacgccgagctcgacgccgtccggcaccgcgaaatcgaccggcagtccatccttcacgaggacgatctgcacctgctcgagcagcgcggcatcggccggctgccgatcgacgaccgcgaccttgcacgcgctcggcggcagccgcccggcctgctccgcatccttcacgacgaatgcggacacgccgacatgcagcgcttcctcggtgatctcgtccgcgagctcgccgatgttgcgcaggtcaatccaggaaagcttcttcaaggccaatctccttcgaaggggataaagcaggttgaatgacagggtgaaactagcgactgacggaaacggccgaacgcgacgcggcggcccgcatccggcaatccacccagccggcgcccggctcgtagccggccagccggacgccgggcgcgacatcggcgagcccgacggccgtgccgccgtcggtccggaaccgcaccgcgcggtcgccgcgcagcacgacacgcgtgctcgtgccggatgcgctgcgcgtgtgcaacgcgacgagcggcgcggattcgatccgcacgcggccgaccacgatcgcgcgcgtgtcgcccgccgcgccgaccgtcaggatccgctcgcccgaacgcagcagcgaaagctggcgcgcgcggtcgccgccgcagaacacgaacgattcggccgagccggcgtcgatgccgaacacgagcggccggcccggcgggtgcgcggcgccggccgcgacgacgagcagcatgctggtcgcgctcgcgccggccagcacgcactcttcgccgtcgagctgcgaacagccgtcgatcaccgcatgcaacccgacgccgagcggctcgacgcgctgcacctcgaatgccttcagcttcagcggctcgcgcgagcgcagctcgccgcacgcggccagcacgccgcgcaacgccgccgcatcgcgcggtgcgaacgcgatgtcgaccggcgactgcgcatgcttgcgcgcgagataggctgcgccgtgcggatcggcgagcgacacgacgatgcggcacgcggcgtcgcggacaccctcgagcaggcgctcgagcggcatcgtggtcgcgagcgcgtagtcgagcaggacgagcgcatgccgcgcgatcgcggcgcgcgcggcatcgaaatcggccgcgccgtcgatcctcacgcgaacgcccgcgagcggcgcatgcgcgtcgtcgaccagcgtcgcgacgcccgccgtcgaaacggtcaatagcgccgccgcgccggccgcgcacgtatcgcgaccggcctcgcccaccacgacgcggcgcgcgccggccctcgccgcgtcggccgcgacggcgcctgcctgcgcgccgagcgcgcgcaggtcgatccacggatagcgatgcatggaaaccctcgatggtcgaaaaagaccgggtacgacggcccggcgcagcggatcaggcggccaggtgcgcggcgcggcgctcgacgccgtgcaccgcgtccgacaggcggcggatcagcggggcggccttcggcgcggcgaacacgttgcggccggccgcgatgccgagcgcgcccgcgttcatcacccgcgacgtgaacgcgacgaactcgtcttcgggcagcttcgcgccgcccgcgaccagcaccggcagcgacgaaccggcaatgatgtcggccatgctcgcggcgtcgccgctgtacggcagcttgacgatgtcggcgccgagatccgccgcgacgttcgccgcatgggcgatcagttcggcctgcggacgatcgccgaggccggggccgcgcggatagatcatcgcgagcagcggcagcgaccagcgcgcgcattcggtcgcgatgcggctcaggtcgagcagctgctgggattccgttttcgagccgagattcacgtgcacgctgaccgcgtccgcgccgctcgccagcgcgtcctcgacgctcgcgaacagcgtcttcgcgttcgcgtcctccgcgtagcgcgtgcaaccgttcaggtgcacgacgagcgcgagatcgctcagcacgtcgggcgccaggaagcgcgcgcggccccgatgcacgacgatcgcgtcgccgccgtgcgcggcgatgtcgccaaccagttgccgcaactgctgcggatgggcgatcggcccgtccgcgagcgaatgatcgagcggcaccatcagacacttgcccgacgcggcacgcaccacccgccgcatcctgagcgccttgccagaaaccgatagaagagcgttcatccgtgattcctcgccagaaatggaaaggccggcccgttcgacgtcagcctgccccggggtgcccgcttgcgggcggaactggagcgacaaccgagcaacgcttgcagcaaatcttgcgacgtgtaagacttgcatagacccaatcatcctatgattggatcatccttgcaagtgccttgcgagcgatcctgtttcccgaccggggacgcattcgtcgcggcatcgcttccctttgcagacaacggcagcacatcaacctgtgaggtgtctatgaagttcggcgtgtccttcctgcccgataccggcccggccgaccgcccggcggccgactattacgcccaggcgctgaagctcagcgcgctgtccgagcggctcggctacacgtacgtgaagatgaccgagcactacctgaagccgtacggcggctacagcccgtcgccgctgatgttcctcgcggccgtggccgcgcagacgaagtcgatccgcctgatgacgggcggcatccaggcgtcgttccatcatccgatccagctcgcggccgaagccgcgcagctcgacgcgatctcgaacgggcggctcgagctgggcttcgcgcgcgccttcctgccgtacgaattcgatgcgttcggcatcgatctcgactcgagcaagacgcgcttccagcagacgatcgacgcgacggtgcggcttctcgccgaggaatcggccagcgaggacaccccgttcttccgctaccgcgacgcgcaatcgctgccgcgcccgacgcagcagccgcgcccgccggtgtgggtcgcggcgctgctcacgccgtccagcttcgagtggatcggcgaacgcggcttcaacctgctgatggccgcgccgccgcgcaaggccgcgctcgcgaagacacaggagatggtggcgctctatcgcgacacgttcgagcgccatcacggccacaccggccgcaagccgcaggtcgcgatcagcatcccgctgatgatcggcacgtcggacgcgcatgcgctggcactcgcggagccgcgcctgcgccatcactggcgcaatttcgcggaagcggcgaaatcgtgggagcaggtgcagtcgccggcctaccagggctacaacgaagcgatgaagaacaagatgggcggcatggacacggccgacctcgacgcaaccgccgtgctcggcacgcccgacaccgtgcgccagcgcattcgcgcgctcgaggccgacctcggcctcgacgcgatcctgtggcacatcgactacggcgcgcagccgtacgaactgatgagcaacaacctggaggtgttcgcccgcgacgtgctgccgggactatgacgccatgccgattccttccggatccaccacgggctcgcccatgacaccgtccctgtcactcgacacgatcgtcgtcggcgccggcatcggcggcctcgccgccgcgctcgcgctgcggcgcgccggccatcgggtcaccgtcctcgagcagagccgggcgtttcgggaagtcggcgccgggctgcaggtcgtgccgaacgccacgcgcgcgctgcgtgcgctcggcgtgctcgaccggcagcggctggccgccgtcgccccgatcgcgacgatccgccgccgctggcaggacggcagcctgctcggttccttcccgctcggcgacgatgtcgaagccgagttcaacgcgccgtactggaacgcgcatcgcgccgacctgcatgccgcgctgctcgatgccgtgcgcgacccgtacacggccggcccgccggtcgccgtcctcggcggcatcgcggtgcgcggcctcgacgcatacgggccggacggcgcgacgctcgtcgatgcggcgggcacgcgctggcgcgcggatctcgtcgtcgcggccgacggcattcattcgacgctgcgccacgcgctgctcggcgacgacgcgccgcactacagcggcgacgacgcgtatcgcgcgctgatcgacgccgatgcgatcgacccgcgctcgcccgtgttcgagatcgtcagggaaccgcaggtgacgatctggctcgggcccggccggcatgcgatccattactgggtgcgcgaccgccggctgctgaacctcgtcgtgatcgtgccgggcgacggcagcacgcgcgaatcgtggagcagcaagggcgaccgcgcgacgctcgaggccgagctcgacggctgggatccgcgcctcgtcgggctgatccgctgcgcgtcggacctgagccgctggtcgctgcacgaccgccagccgctcgcgcgctgggtgtgggacagcgtgtgcctgctcggcgacgcatgccacccgatgctgccgtaccagtcgcaaggcgccgcgcaggcactcgaggacgcggtggtgctcggccggtgcgtgaccgggctcgcgtcgaaggacgcgctcggcgccgcgctggtcgaataccagcgcctgcggatcgaccgcagcgcgcggatccagcttgcatcggccggcaacggcggcgtgttccacctgcccgacggccccgagcagcaggcgcgcgacgccgagctcaagtcgcgccgcgccgacttcaagtcctatcactggacctgggccgacgcgtaccagctttgacgcccgccccggcgccgcgcggcgcgacccgcgcggtaccggggctcctcgcgacaggaccgcatcatgacgaacaccgtggacattgcgcagcaactgaaacaggcgatgcgcggcgtggccgccaccgtcacgatcgtgacgaccggcggcgacggcgccaccgccgcaccgtgcgcgctgaccgccagctcgttcacgtcggtcgcgctcgatccaccgaccgtgctggtgtgcatcaaccggcgcgcgagcattcacgcgtcgatcaccggccgccggcgcttctgcgtgaacgcgctgcgaagctgccacgtgccgctcgcgcttgcgtgcagcacgacgggctccgacgcgcgtttcgcgcacgacgcatggcgtaccgacgcggcgacgggcctgccctatctcgagaacgcgcagacgtcgttcttctgcgacacgctcgaacaggtcgaggtcggctcgcattcgattctggtcgggcgggtcacgcgcgtcgcgatgtccgccgacgtgaacccgctgatgtacgtgaacggcgcgttcgccgccgtccgctcgctgccgtccgatgccggcggcgggtaacgggcgcacgtgacgttgtttcgagcattcgttcgcggggttcgcaccaggcccgtgtgctcgaggaaacacgcccccaccgatgcgtgcgtcacgcgtgatgcggcacgcaatcgttgcgtgcgccgcagtcacgctgcgcgcgcacatcacgcactaccattgcgccgcatgcacgcgatgaaacggagaagccgatggcacccgacctgaacctgctgatttcgctcgatgcgctgctcgaagagggcagcgtcgtcggcgccgcacgccgcatgaacctcagcccgcccgcgatgagccgcacgctcgcgcgcatccgcgaaacggtcggcgacccgatcttcgtgcaggccggccgcaagatggtgccgacgccgcgtgcgctcgaactgcgcggcgtcgtccgcgaaaccgtggagcgcgcatcgcagttgctcgcgccgtccgcggaaatcgatctcggcacgctcgacaagcagttcaacgtgcgtgcgaacgacgtcttcgtcggcctgcacagcagccggctgctcgaggagatggcgcgcgggatgccgcgcgcgatgctgcgcttcatgcccgaggaagacgacgtcgacgacgacgcattgcgcagcggccgcatcgacctcttcatcagcgcgtcgcgccgcctggggccggagattcgcgtgcagccgctgttcacgacgaccttcgtcggcctcgcgcgccacgaccatccgatcttcgacgacgacatcacgcccgagcgcttcgcgcgctggccgcatatcggcgtctcgcggcgcggcaagtcggcggggccgatcgacgacgcgctcgccgcgcgcgggctcgcgcgccacgtgctgctcgtcgtgccgacgccgtatgcggcgatcttcgcgctgcaggcgtcggacctgatcctgccgctgcccgagcatctcgcgcgcggcgcggtgcgggccgggctcggcgtgcgcacgttcgaactgccggtgccgctcgaaaccgtgctgatcacgcaggcgtggcatccgcgcttccagagcgaccccgcgcaccagtggttgcggcgtgtcgtgcgcgggctgtgcaccggccagccggcgctgcgtgcggcgcatgcatgacggatgcgttgcacgcactcgtcgagtgcaaagacgtcactgttcggcatgcatggcgcgaccgtagactggcttcgtcctttctcatggagcgagtgcagtgcatgacgcagcagatcagacgcgcgccgtcgcggcgccgccccgccgcctgactcgcgcggccgcggcgctgatcgcgcgcatcgacatcttcacgccgcgcggcgcgtatgtcgcgcgctcggtcatcgccgccgcgctcgcgctcggcgtcgcgtacctgctcgaactggaaacgccgtattcggccgcgtcgacggtgctgctcgtgatcaatcccgtccagggcgcggtgatcggcaagggcgtgtggcgcgtggtcggcacgatcgcggggatggtcgtcgcgttcgtgctgatgggctgcttcgcgcagcagccgctgctgttcatcctcggcttcgcgttctggctcggcgtctgcgtcgcgggcatgacgctgctgcggcacttccgcgcgtcgggcaccgtcgtggccggctacacgatcggcctcgcgacctacggcgcgatgcagcatcccgagctgaccttcgaacacgtgatcgggcgcggctcgacggtcgcgatcggcgtgctgtgcctgagcctcgtgtcgatgctgctcggcacgcgcgacgtgcacgcgaaactcgacgcgctggtgacgcgcgtcaccgccgacgtcgcgcgggtcatcgccgcgcagcgcaacggcctcgccgctgcaccggccaacgacaagcggcacgcgctgttcgccggcatctacggcatcgacgatctgctcgcgctcggcaaggccgaatcggaggatctcgcgcaacgcgcggccgccgtgcggcacgggatggcatcgctgttcggcgcgctcgcgggcggcatgccgccgctgccggccgacagccccggcgcgcgcgcggtcgcatcgcttcagccgcgtctcgcggccgcgtggcaagccgccgccgacgcattgggcgacggccccggcggcgcgacgcacgcgcatgcgctgctcggcgatgcacgcgaacgcctgcgcgacgcgctcgacggcatcgcgctcggcgatccgcgcgacgatgcggcgttgctgatcgccggcgagcggctgatcgaacagatcgacgactaccgcgcggcgctcgacgggctcgtcgaactgcagcgcccgcgcccgggctaccggcccgcgcgggtgcgctttcaccgcgacacgggcgcggccctgcgcaacggcgtgcgcgccgcgtgcgcgatcgtgatctcgggcgcattctggctcgcgaccggctggaaccagggcgacatgatgctgctcgtcgtcgcgccgtactgcgcgctgctcgcgaccgccggcaacccggccgccggcgcgcaggcgttcatcaagggcacggtgctcgccgtgccggccgcgttcgtgtgcgcgttcggcatcctgccgcgcatcgaaggctttccgctgctcgtcgtcgcgctcgcgctgttctggatgcccggcatctacgcgacgagcgtgccgaagaccgcgctcgcggggctcgcctatctcgtcgcgttcaacacgctgaccggcgcgaccaatccgttccgccccgacgtcgcgctgttcctgaaccagtcggtcgcgtgggtgctcgccacgttcctcacgctgctcacgttccggttgatcctgccgggcaacctggccaccgacgccacgcggctgcgccgcacgatccgcgacgacacgctcgcgctcgtggccggccggcgcgtcacggcggcgggctggcagcagcgccagcagcaccgcatcgcgcagctcggcgcgctgctcgccggccagccggccgcgatgacgcaggcgagcatcgaggcgctcgcggcgctgcacgtcggcaaggaactgctgcggatccgccgcggcgccgcgcgcgacggcctgcccgaccccgcgcggcgatgcgtgcgggcggggctcgcgggcctcgcgcggcacgcggccgcccgccgcgcgcggcccggcatgcacggcgcgccgcgcacgcgctggccggcctcgccgccgcgcagccgggcaacaccgaactgaagtggctgatggccgcgttcgccgacgtctacgtgctgctgcacacgtacgccgcctatttcaccgccgttccggagcgcgcccgcgatgctcagtgaattcccgctggccggcatctacctgccgccctttttcgtctatgcgtgcgcgaccgtgccgctctacctggccgtgcgcgcgctgctcgcaaggctcggcgtgctgcgccgcgtgtggcatccggcgctgttcgagttcgcgatttcgctcgtgctggtcgccacgctgatcctctatttctagcctcccgtcggaacgtatcgcgtcatgtcgctcaaacccctcacccgctccctgctgacgctcgccaccgtggccgtggcgatcgtgctggtcgccgcgctctggcatgcatacgtcctcgcgccgtggacgcgcgacgcgcgtgtcagcgcgcacgtcgtgcggatcgcgcccgaagtgtcgggcaccgtcgtcgaagtcgcggtggtcgacaaccagcgcgtcgcgaaaggcgacgtgctgtaccgcatcgatccgcagcgcttcgcgctggcggtggaacaggccgaggcgcaggtcgccgcgaccgccgagtcgatgcgccagaagcgcgacgaagcgcaacggcgcaccggcctcgacgatctcgtgccgcgggaggacatccagcgctcgagccgcgcggtggcgatcgcgcaggccgagcaccgcaaggcgctggccgcgctcgacgtcgcgaagctcgacctcgaacgcacgacgctgcgctcgccggtcgacggttacgtgacgcagctgcgcctgcgtcacggcgactacgcggtcgagggcaagcccggcatctcggtgctcgacgcgcacagcttctggatcaccggctatttcgaggagaccaagctgcgccgcgtcgcgacgggtgcacccgcgacgatccggctgatgggcttcgatccgctgctgagcgggcacgtgacgagcatcggccgcggcatcgccgacgaaaacggcacgctcgacgaactcggcctgccggccgtcaacccgaccttcagctgggtgcggctcgcgcagcgcattccggtgcgcatcgaaatcgaccgggtgccggccggcgtgctgctggcggccggcatgacgtgcagcgtcgaagtcggcgaacgcgggcgcgagcgcacgccgcgcggccggctggcgtcgtggctgcatgcgtggatgtgacggaggcgacgatgcgatgcccgtttcctccggtgcgcgcgacgtgccgcatgcgcgccttcgtcgcggcctgcgcgtgcgcgctcgccgcgtgcacgacggtcggccccgattacgtggcgccgcagcccgcgcacccgcccggctggagcgcgccgcgcgacacggtgacggccgaccccgcgcagttgcaggactggtggcgcgcgttcggcgatgcgcagctcgatgcgctggtcgagcaggcgatcgcgcacaaccaggatctcgcgatcgcgcgccagcgcttgctgcaggcgcgcgccgaacgcgaccagatcgcgagccgactcggcccgaccgtcaccgcgggcgggaacgccgatgcgctgcgctcgtcgcgcgcgctcgaatggccgcccgggatcggccagtcgcgcacctaccgcctcggcttcgatgcgtcgtgggaactcgacctgttcggcggcacgcgacgcgcggtcgaatccgccgatgcgcagatcgacgcgctcgacgacgatcgccacgcgatcctcgtgagcctgctggccgagcttgcatccgattacgcggaactgcgcgcgacccaggagcggctgcggatcgcaacggacaacgtcgcgagcctcgacgccacgcggcagctgaccgagcgctcgaaccggcgcggcctcggcacgtcgttcgcggtcgcgcaggcgcgtgccgaactgcagctcgcgcaggcggcggtgccgccgctgcagcaggacgtcgcacggctcgcccacgcgatcggcgtgctcgtcggcggttttccggaaacgctgcgcgacacgctgagcacgcccggcgcgaccctgccggtcgcgccagcgctgcccgtcacgctgccgtcggacgtgatccgcgagcgccccgacattcgcgccgccgaacggcggctcgccgccgcgaccgcgcagatcggcgtcgcgcgcgccgagcagtttccgcatttcgcgattccgctgagtctcggcacgacggcgagcctcgtgcaggacctgttctcgggcgcgagcgtcgcatggtcggtcgcgctcgacggcacgcagacgctgtacgacggcggccgcgcgaaagccggcgtcgacgccgcgcgcgcagccgccgaagtggcccggctcgcatacgagcagcgcatccgcggcgcgtttcgcgatgtcgaggacgcgctggtggcgatcggcgccgcgcgcgaccagcaagccatgctcgccgcggcggtcgacagcagccaggatgcgcagtcgcgcgcgacgcggctgtatcgcaacggcctcggcgaatacctgtcggtgctcacggcgcagcgcgccacgtaccgcgcacgcgatgcgctcgcactcagccggctcgcccaggtgcagggcgcgatcgcgctctacaagtcgctcggcgtcggctggcgcgccgcgccgccggtcgtgcaggccgccgcggcgcaagcgagcgcgcattgaatgcccacgcacggccacccgacgctccggcgtcgctcatccaacggagaaccctcgatgtccgctctcaatccgaatgatttcgcgctacacgacatccatctctttccggtctgcgtgtttcgccccgaacacgcgacaccagctacgcgccgcgctgggaaggcgagatcgacacgctgatgcgccacggcgagccgttcgtgatcgtctacgtcgaactcgacaccgacgagagccacgacgaccgcaagcatcgcgcggtctggctcaagcagaacaaggtcgcactgggcgccgtctgcaaggcgctcgtcagcgtcgaacccgatcccgaccggcgcgcggaagtggccgcgcagggcgaggtcgccgtcaaggcattcgggattccgcatcacgcggtggcgtcgttcgggcaggccgtctcgctcgccgctcggctcacgcggcagcatccgggcaacgacgcgctgcaaaccggacaacaggcatgacggggccggcatgccgggccacgtcgcctccgccaccgacacgagggccggcatgcgctatcccgccctgacgatcaccggctcgcacacgcttgcgtcatgtccgtcgcggctgcccactccgggcgagatcctgttgtggcgactgcgcggcgaatggcagctcgtcaccagcgagcaaggccatctctgcctgtcgaagacggaactgcggcgtgccaggatgcatccgaaccgcgcgcacggccgccgcttcgcgattggccggtcggcgctgcgcgcgatcctggggacgctggccggccgcgccgccgacgagctcacgctgatcgagcgcgaggccgaccatatcgcgatcgcgggctgcgactcgctggacgggctcgacatcgtggtcggccacgccggtatctggatcgtgatcgcgatcgcccgtggccagatcgggctgggcatggcgcaagccggcacgtacgccggtgcggcatcgcgcgaccagcttcggctggacagcctctcgaatgcatgcggaagcggacacggcgcgacgctcgcgtcgctggcgccgtttgcgggaccgttccgcgaggtcgatacgccgcatgcgggccgctggcgcctgctcgacatcccgctccccggcctggtctgcgcggctaccgttgccgcgcgccagatggacaagatccatgcggtgggctggcgcggcgagcgcaaggactggctggccgaccgcgatcgctacctgcgggcggcgacgtcgaggagcacttcagcctgcgtcgcggtcgagtagaccggcttcgacgcccgccgaattcacgcggtggcgattcctgcgttcggtatcggacatgggagccgtccatgggaacgcgagaagggagccggttatgggagccccctccctcgctgccactccgtcagccggcgaccatcgcacccgctttcacgtgccggcccgctcggcgcagcaactgcacgccgaaccacagcatccacaacggcagcacgaggacgacgacgacctcgctcgcccccgtcacgacttcgtattcaggaaagaaaccggacacgaagatgatcgcgaagaaccacgcgacgatcttcagcaggaacgacccgtgccatccggcctgtttcaaccggttggcggcgatcggcgcccagaagaacaccagcgggccttcggcccaccacaacccgctttgcgtgccgttggcgatggtcgtccacgccgcggccgcggcggccctcgttgggtcgtctccgcccgcatacatccgcgccagcggatcgagcaccgacagctgcaatgccgcgccggtgatgccgagcaccgcatacgccccgatcgcgaacgcgatcatgtagccgagcgcgccgagttcgtccttgaaggtatgcaggaagtacccgccgatcacgagaaccgcgagatagaacccgaacacgtcggccagcatcgacaggcgaaacaggtcgcgcgtatcggacggcaggctcagcatcgtcgcgccgtgcagcaacatgccggtatccgggccggccaccgccgacaccagccccacgttcgcgtaagccagcaggccgccgacgatcgcgctccacgccgtgaagcgcatgaccttgtatgaatcgttcctcattctctttctccgcacaccatgcccggttcccgcatggagaaccattcgattgacgttgacaggcccgatcgcgcgacgccggaaaccgggccgctcgatcggtaattcacgacaacaacgataggtcgatatgacaaacatgaaatcgacacgaaacacgagggcattccctcgtggctgcttcattcagcgcgatgcgtgacgcatcgcacttacgtcacgccgctgcgtttccttgagcggccgccgcctcttccctttcctgcaattcccgccacaggatctttcctgacccggatttcggcagcgactcgacgaactccacgatgcgcggaaccttgtaggacgccatatgatcgcgcgaccatgcgaccacgtcgtcgggcgtcacgccgtcgggatacgccggatcgagcacgacgaatgccttgacggtctcgccgcgatgcacgctgcgcgtgccgatcacgcacacttccttgatcgccggatggcggtacatcgtcgtctcgacttcggccggccagaccttgtagcccgacgcgttgatcatccgcttcagccggtcggccatgaagaagtagccgtccgcgtcaatgcggccgagatcgccggtgcgcaggaagcgcttgccgtcgatctcgacgaacgcctgccgcgttgcttccggattgcgccagtacccttgcatcagttgcggcgcatgcatgacgatctcgcccacctcaccttgcggcacgggctggaacgtgaccggatcgacgatccgcgcatcgacgtcgaacaccggaataccgaggcactgcggcttgggatgcgcgggcggattgatgtgcgtcgccgcgatcgtttccgacatcccgtaaccttcgacgtagtcgagcccgaccgtttccctgagcttccgggcgatcgcttccggcatcgccgcgccgccgccgcgcgccgagcgcaggctcgacaggtcgtattcgtgcaggttcgggttcgacaggaaatccaccatcatcgtcgagatcgactgccacacggatacgcggttgcggccgatcgccagggccacggcatcgcgatcccagcgcggcagcacgaccaccgtcgacccgcggtacagcgggccgttcaggccgccctgcatgccggtgacatggaacagcggcagcaccgcgaggtggatcgcgtcctcgggatcgtcgaaccagtcgacgaagccggccgccgtgcacaagacactacgatgcgtgtgcacgcagcctttcggcttgcccgtcgtgccggacgtgtacggcatcaggcagatgtcgtctgggcccgccgtcagttcgcccggcgccagctgcgcggcgagcgcatcgcgccagtgcaccacgccgggcccgtcgacgtggcgcggcgcggccacgaaatcgggcaccgcgacggccgaaggttgcgccacgtagtcgccgtacgtcaccacgacgacgttcgcgaggccgtccgcgccgcccacgagcggcgcgacgcgcggatacaggtcctgcgcgacgaataccgtgctcgcgccgctgtcctcgatgtaatgcgcgagttcgtcggtcatgttcatcgggttgaccggcacaaccaccgcgttcgcacgcaggatgccgtagtacgcaatcatccattgcgggctgttctgcatgtccaggagcacgcggtcgcccgccttcaccccgcaacgctgctgcaggaaacccgccacgtgctcggcttcgcgctggaagcgcgcgaacgagaccggcgtgtcgtagaacaggatgaacggcttgtcgggatggcgcgccgccgcggcctccacgtgacggaacaggttggtcgcgggcggcacctgacgcgtggccaggtgcgcaggccagaatggcgatcggatggctgacatggttcggcaactcttcgtcaaaactgcgggtgagaaatggcagcggcgggaccggccgtcccgacactgcgtgcacgcattcgtttggccgggtgaacgtccggcgccgacggcaaccggacagcccctatcggccggtatcgatgcccgacgtcgtgaaccggtgcgtttccgccgacgccgccgtcgcatgcgccgcggatgccacccggctgacgccgcgcatcatgtcgaccgccttctccgcgatcatgatggtgggcgcattggtgttgccgccgatcagggtcggcatcaccgatgcatcgacgatgcgcagcccgtcgaggccatgcacgcgcaactgcggatcgaccacggccatcgcgtcctgtcccatgcggcaggtgccgaccgggtgatagacggtatccgcacgcttgcgcagcacggcgcggatctcgtcgtcgctgtgcacgtcgcgcgtgaacatgtcccgcgtgatccactccgcgagcgcgggcgcgttcatcaggccgcgcgtgatcttgaagcccgccaccatgtcctccaggtcgcgcggatcgtcgaggaacgcgggatcgatcagcggcgcgtcggccgggtcgcggctgagcagcgtgaccgagccgcggctgcgcgggcgcagcaggcacacgtggcaggacagcccgtggcccaggtgcatgcgccgcgcgtggtcgtcgaccagcgccaccaggaaatgcagctggatgtcgggcgcgtcgaggccgggttgcgtcttcaggaacgcgccgccttcggcgaaattcgacgtcagcatgccgcgccgctcgcggcgaaaacgcaggatctcgcgcagcatccgcgcgctgccgcccaccgagatgcccatcgtatcgaggctgcgcgtgcggtagctgaagatgaagtcggggtggtcctgcaggttgcggcccacgccgggcagatggtgcagcgtgtcgatgccgacgcgcgcgagctcgcctttcgggccgataccggacagcatcagcagttgcggcgtctgcagcgcgcccgcggccagcaccacctcgcgccgcgcacggaaggtcttcagcgtgccattctgcagcacttccacgcccaccgcgcgcttgccctcgaacaggatgcgccgcacctgcgcgtgcgtttcgacggcgagattcgcgcgtttgccgagatgcgggaacagatagccgcgcgccgcgctccatcgttcgccctgcttctgcgtgacctggtagataccgacgccttcctgctgcgcgccgttgaaatcgtccgtcagcggcaggccggcctggcgggccgccgccaggaagcgtgcctggaacgggttgtcggagcgcaggtcgctgacccacagcgggccgtcctggccgtgccacgcgtcgttgatgcgctcgttgtgctcgctcaggcggaagtacggcagcacttcgtcgtacgaccagccgggattgccgagcgcggcccacgtgtcgtagtcggtgcggtggccgcgaatgtagaccatcgcgttgatcgccgacgagccgcccagcgccttgccgcgcggctgatagccgacgcggccgccgaggccgcgctgcggcaccgtgtggaaggcccagttgttgaggcgggtcggcaacatcgcgaccatgcccgccgggatgttgatttccatgccgttgccgccgccgcccgcttccagcaggcagacggaggtgttcgggtcttcggtcaggcgccctgctaccacgctgccgcccgagccgccgcccacgacgatgtagtcgaactgatgattcatggcatttctctcgatacgggattcggaagtcacgcgagtcgcgacagcgtgcgcagcagcagatcgaagacgcggccgtacggcggatggaacagcacggcaccgttccagcgggcctggtgaaacaccggcttcagtttgctgaaggtgtcgaagccccactgcccgtgataggcgcccatgccgctctgcccgacgccgccgaacggctggttctcctgtaccaggtgccacaggcagtcgttgatcgtgacgccgccggacaccgtctcgcgcagcacgcgatcgcggcgcgatgcgtcttcgccgaaccagtacaacgccagcggacgcgcgcggccctgaatgtaggcgagtgcatcgtccaggttcgcgtattcgacgatcggcaggacggggccgaagatctcttcgttcatcagccgcgtgtcggccggcgcgccgaccacgatcgtcggcgcgaatttgcgcgacgacgtgacgaacgattcgccggccgggttgacttcgaggatgcgcgcgcccgcgcgacgcgcttcatcgaccatgtcggcgaggcgcgcgcggtggcgttcgctgatgatggccgtgtagtcgggattcgcggccagcgtcggatacaggcgcgcgacggcgcgcgccagatgcgacgcgacgctgccggccgtgccggtgggcacgagcaggtaatcgggcgcaacgcaggtctggcccgcgttcagcagcttgccgaacgcgatgcgctgcgcggccaccgctacgttgcacgacgcatcgaggatggccggcgatttgccgccgagttcgagcgtcacgggcgtcaggttggcggcggcggtttgtgcgacgacacgccccacctgggtcgaaccggtgaagaacaggtgatcgaacggcaggctcgcgaacgccttgccgagttcgacgtcgcccgccacgacgtccagctcgtccggcgcgaaggtctcgcgcgccatcgacacgagcaggtcggacagcgcgggcgtgagctcggacggcttgatcaggacgcgattgccggcggcgagcgccgcgagtgccggcccgagcgaaagctgcagcgggtagttccacggcgagatgatgcccgtcacgcccagcggctgcgggatgagccggttgtagccgggccggaaatgcagcgcggtcgacacgcggcgcgcccgcatccagtgcttcaggtgtcggcgcgcgtgccggatgccggcgcgcacgatgaacacctccgcgagccgcgtctcgtgagcggagcggccctgaaaatcggcgtcgatggcgcgcacgatgtcgtgctcgtgcgcatcgagccacgcggccagccgttcgaggcgcaccagccgggtggccagggccgggttcggctccagcgcgaaggcgcggcgctggcgctcgaagcgggccgcaaggtcggtcgggtagccttgatgcatggtgtctcctccggcttgtcgatcgtgcgatcgcgtcgcatcacgacaagcgtcttgcaagatgttcctggttttcacgctgccttcgggcagttcgtttgccggcgattgcgcgagcgccgcgccacgccgtctcctcttgtcgcgtgccgcgcgctaaccggctcacgcaatgtgcctgccggcacgcacgggttcggcggcagcgcgtgttgcacggtgccggatatggccgtcgatcaggctcgtcagcagcggcacgacgccatcgggaatgtcgtgccccatgccgcgcaccgtcaccatgtcggcacccgggatcgcggcagcggtcgcgacacctccactcggcgcgaccagcaggtcgcgatcgccgtgcacgaccagggtcggcgcccggattcgccggatttcctcggttcggtctcctgacttgatgatcgcgccgatctggcgggtcgtgctctcgtggtcgcgcgcctgctggccgcggtcccacgcctgggccgcgtacgcgcgccgcgcggcgtcgtccgcgggatacgcctgcgtgccgatgtgggccatgatgcggctgtactgctccaccgccgcttcgcgcgtgcgcggcggcggtgcggtcagcatcagcatgctggacatggccggctggccgacgttgcgcgcaccggtcgtggagatgatggaggtcagcgacagcacgcgttgcggatggcgagcggcgagcacctggccgatcatgccgcccatcgacatgccgacgacgtgcgcgcgcgccaccttcaggctgtcgagcaggccgatcgtgtcctgcgccatgtcttccaggtcgtagccgtccttgacgggcacgcgcaggaattgccggagcacgctcggccccggccgcgcgatgcgcgacgagcgcccgacatcgcgattgtcgaacacgatcacgcgatagccgcattgaatcagcgcgccgatcagcgcaggcggccagaaggtcaattgcagcgtcatgcccgcgatcagcagcaacggctcgccgtcgtcgggcccgtaggtgcgatagcagaggcgcaccccgcccggcaggtcgcagaacgcgtcctggattgcttccatggcgtggatcgtcatgatcaggctccgacggcccgacgggcctcgacgcgatccgtgccgcctgctgccggcgcatgcctgaaacgcaggttcggatcttcgaccgggccatgccgcaatatcctgacgtcgacgtgatagtccatcgacatgatccacggcgtgcccgggccctggcgcggcaggccgtcgatcgcgcgcttgatgtagccggcaccgaaatcgagcagcgggcgcgtcggcatgtcggcggccggcaattcgggcatgcagaccgcgtaaccgccgcgctccatatgcgtcagcaaacgacagaagtgttcggccagcagcccgaccttcatcgtccacgacgaattcgtatagccgatcgagaacccgaagttcggcacgccgctgagcatcatgcccttgaaagcgaccttgctgtgcagatcgaccggctcgccgtcgaccaccagcttgatcccgccgaagaacctgacgttgagccccgtcgccgtgacgatgatatcggcgggcaaggtctgcccggattccagcacgatgcccgtttctgtgaaggccctgatgcggtccgtcacgaccgatgcgcggccatcgcggatcgacttgaaaagatcgccgtccggcaccacgcacaggcgctggtcccacgggttgtacggcgggttgaaatggacgtcgaccggatagtccttcggcaactggcgcttgttcaggtagcggatcaggcgccgcgccgcctgcggacgcgaccggcagaagcgccagatgaagcgggaaatcgcgacattcttccgacgcacgatcgcataggcccacttgtgcggcatgatcttgcgcagcgtattcgcaatgatgtcttcggacggcaggctcaccacgtaggtcggcgtgcgctgcagcatcgtgacgtgcccggccttgccggccatggccggcaacagcgtgacggcggtcgcgccgctgccgatcaccaccacgcgcttgccgccgtagtcgagatcttccggccagtgctgcgggtgaaccaccgtcccgccgaaattctcgatcccgtcgagcttcggcgtgtagccttcgtcgtgccgataaaaccctgcggcgctgaagaaccacttggccaggatcgtcttgcgttcgcccgtatcgaggcgctcgacttcgacgttccacagcgcctgcgcactcgaccagcttgcctggatcaccttgtgattcacgcggatgtgacgatcgatcccgtattcggtcgcggtctctctcaggtacgaaaggatcgaatccgcaccggcgatcgccttcttgtcggcccacggcttgaaaccgtaaccgtaggtatgcatgtccgagtcggagcggatgcccggataacgaaacaggtcccacgtgccgccggtcgtggcacgcgcttccagaatgaggtacgacgtgccgggacggtccgtctcgagttgacgggcaacgccgatcccggaaaggccggcgccaacgatgagcacatctacatgctcggtggacggaagagggtgtacggtcacggcgtgtctcctgattgcgtcgaaatgcgcgatgtgtcgttattgttatcaaccgaaccgcaccaaacaaggtgtcgaacgcacagtacgcgactacaattagtgcaacttgcacctcttcatttgcgtctcgcctgccatgtcccagaacctccctccatgaccccgccgccatggccgatgccgtcgcctcgcatccgggaattgatgcgtcagggtgccgagatcgcgctgaatgtgcagacggaatggctgcaggaactcgacaaggaaaacgtggcggccagcgcgacgatgagcgaccccgtgctcgcggcggccgtgcggcggatcaaccgcaacgggctgattcactgggcaacctccaatcttgagaacccttgcgcgccggtatcccgcttcctgtccgccgacatgctgagcagtgcgcaggaactggtgcggcgcggcctgaccgacctcgtgttcgtcgcggcccgttcgtcgcagagcgtcgtgtggcaacgctggatggagctcgcgtttacgttgacccaggacccggaagaactgcgcgaattcctcgccgtgtcgtcacgttcgatcgcgacgttcatcgacaccaacatggtcggcatggcggagttcatgcgcgccgagcgcgaagcgcgactacgcggcacgcacgccgaccgtcgcgaactggtcacgcagatcgtcgagggcacggccatcggcacgcaagaggccagccggcgtctgggctacacgctggagcagcgccatcacgccgcgatcgtctggagcgaggaagcggatatcgaactgggtttgctggagcgggccgccgacgcgctggcccaatgcgcgggcacgcgcaatgccctggtcgtcgtcgcgaacacggcgacattgtgggtctggacgtatcacgacggcaaaccgctcgacatgccctggttgcagcgtgcgatcaacacgctgcccggtgtgcacatggccgtcgcgaccgccggcagcggcatggaaggattccggcatggccacctggacgcactggcgacgcagcggctgctcggcaggctgcacgccggcgtcggcgtggtgcatgcggacagcatgagtctgatcgcgctgatgaccaatcacatggagtccgtacaacagttcgtcaccaatacactgggcgagctggccaccgccgacaagtcgctgcgcgccgcgctgcgcgcgtttctcgcggaaggctgcagcgtgaccgacgcggccgagaaaacccatgttcaccgcaacacgttgctgcgccggctcgagcgtgccgaggcgctgctgccccgcccgctcgcgcagcagcgcctgcacgtcgcggccgcgctggaggtgctgtactggatcgccaacgatccggattgatcgcggcgcatgcgtcgaggccgttcttcacatgcggatgacgtacgcaaacggtcattggcgcgcaacgggacgttgcggtcggctcaaggcgccccgccgctgtcgtgcagttccggcccggcgcacccggcacgacatcgcgcaaccgctgcgtgaccggggacgactacccgctacacgcggtcaccgcacggcgttacctcgaggtcgattttcgtagacgaggcaacggaccgtctccatgaacatggcatcgagctcctgcgtaaatcgcgccgacccggattgcaacgtcaggccgtcggcagtcgcaatcagcagcgtggcgacgtgcaggctgtcggccgtgtcgaacgccggattgacggtgcgcaacagcttcgcgatctcgcgcgtcagcgtgtcgtaccatccgtcgaacagcttgaggcattcgggatcgatggcggcgaacgacaggaaatgcctgaacagcgcaccgtattgcgcatccttcgcatcgctcagcgagcgcgccagcacgcgttcgagtacgtcgtccggcgacgcatcgctgtcgagcacgcgcgtcagctcgcccaggtacgcatcgatggccggctcgatcacggcccgcagcacggccagccgggtcgggaagtaatactgcaggttgctcacgctgataccggcaccggcggcgaccgcgcgctgcgagaaggtcagcgggccgccttccagcagcagctcccgcgcgacgcgaacgatcgtgttgcgcgtgcgcagccctgcgcccgcaagccgtcgggatggctgcccgacgaggcagcactcgtcgcgcgcttccttccgccagcatggtgcgcttcgggttcggtcaccgtgtccggttcgtcgtgacggtgtcgcatggcactatccgcgagccgcacggcggttcacgcgttcgtcgagcaggttcgcgacgcccagcacggccttgatcgcgcaccagcgcagcggctcaggcggcatcgatggcgtgcggtgcgtgagcgccgtgagcagcggcgactccgcgccgatgatccggtcggccagcacctgcccgatcagcgactgcgtgccgacgccgtggcccgagcatccggccgtgtagaacacgttgccgtgcgggccggtcgcgccgaccaccggcaatgcatcgccggcgatcgagacatagccgctccagcatgcacgcaccggctggtcgcccagttgcgggaaacgcgcgcgcagcgtcgccagcagcgcgcgataggccgcgtcgtccggtacgttcggcgtgcgcgagccatagacgtaatccagccgcttggtcgtcaccaccagcgtattgcgcgcggtgagccggtggctctccatcgtcaggtgcggcgtgacgattccctcgcggttcggccagcccagcatcgccagttgcgcatcggacagcggttcggtttcgagcgccgacacgcgcagcggcatcaccttgtcgtcaagcacgccgagttgcggcgtatacgcattggtggcaagcaccatgaccggcgcgcttgcggtgccgcgcgccgtgcgggcccgcacggtcgcgccggcgtcgaagtcgagcagcgcggtgttctcgtagagcctcacgcctgccgcgagcgccgcgcgccgcaagcccgtcacatacttgccggggtcgagcgtgccgccgccgggaaagtggcaaccgaacaggaacgccggcggaatgccgcgcgcccgcagcgccgcgccatcgagatactgtgcgggagaaccgagcgcaatgcccatctccatgttctcgcgcaggcgcttctcctgcgacggatgcacacccgcgcgaatgatccccgtcgcgcgaaagtcgcagtcgatcccgtactcgacgagcttgcgctcgacgtaggcaacgccctcgtcgtagaagccgacgatccgtttcgcctgctcgcgccccacgcgcttcacgaacatctcgtactcgagcccctgcccgcccgcgagatagccggcattgcggccgctcgcgccgaagcccgcgaactcgcgctcgatcacgacgacgctcgcgccgcgcgcggtcagttcgagcgcggtggacaggcccgcgaagccgccgccgacgacgaccacatccgcgcgaacgtcgccttcgagctgcgaatgcatgtcggccggccgctcgatccagccgccgatgggccgataggcccgcaacgtgcggtctgcctgcgccgcgtcgaaccgcatcgccgtgccggtcgagtcattcatattttggtactgcgaattgctcatgtgtgcctccgtcgctcgtttccgccaactggcattccgtgtcatccgggttgccatcagggcgacgtcaatacgccgtcctgcgagaagagaatcgggttgccgcccttgccgggcagcgcggcggtcagcgtcgcacggtccgggcgctgcgcgacctcgaccgtcggggcgccggcacgctgcttcaataccaggccgtcgagcccgacgccgaccaggccgtcgcctgccgccgacaggccggtgatcgaactccgcgtgcggctgtcgacggccgtccagctggcgccgccgtcgctgctctggtacaggctgccgagcaggccgccgaccacgacccggccgtcgggcagcgcgacacccgcccacaacgtgcccttgccgcccgtcgacaggtagcgccagttcgcgccgccgtcggccgacttgagcaccgtcccctgttcggacacgatgtagagcgcgtgtgcggcgtcggcgaacacgtgatagagattgcggtcggccttgccgccgcccggcggcttcgcgagggtcgtgcgcgaccacgtcttgccgccgtcgtgggtctgcagcatcagcgaccacaggccgacggcaatgccgtcctgcgcattcgtgaacagcaccgagaacagcggctggtcgaccgatgtatcgagccgctgcgtgacccacgtgtcgccgccgtcgtcggtcgcgagaatcgcgccccactggccgacggcccagccgtgtttcgcatccgcgaacgacacggccgacagcgtcgccgacaccggcacgcgtcgtgcctgacgccaggtcttgccgtcgtcgtcggacagcagcacgatgccgtgctcgccgaccgcgacgatccgcgacccggcgcgtgtcgcgtccatcagcatcatgtgcgtcggcgcggcccacgtgtgcgcgggtttcgcggcccaggccgcgacggttccgtcctgcggttgcgcgaaggccgtcgcggccgtgcagagcgcgatacaggaaatgagcgtcttgatcatggtgaatcccggtagtgtgcgggcatcagtggttgaaaagcgccgaccagccggcattcgcttcgccgagcaccacggccggcggcttgccgttgccctgcgcggccgctacccgtcgctcggctccgccgtcgttcgacgacgcggcgccacccgtttcgccggttgcggcgtggtgcacaccggtgcgtgtcgcgtccatcgcgaacgcacgagccggcgcactccgacccgcgcccgtttcatgaaatcgcgggaaggcccccgccgcgatgcaaagtacggcgcaaacagttagcgtcttgaccatgaacgaatctccatcggcaggttcacgcgcttcagtgactgaacaaacccggtgcgcgggccggcttgcggcgcgggaaccagcgttcgagcagcgacgcgagcgcgggcaacgcggtcatcgccatcaccaggttcacgatgaacatgaacgcgagcagcttgcccatgtccgcctggaacttcagcgcggagaagctccacgtcgccacgccgatcgcgagcgtgatcgccgtgaagatcgtcgcgacgcccacctcgagcatcgcgtgctgcacggccttcacgatgtgctggccactggcgagatgcacctgcagccggttgtagatatagaacgcgtaatcgacgccgatccccaccgcgagcaccatcaccggcagcgtcgccaccgtcagcccgatctgcagttccttcatgaaccagtagccgatgaaggtcgcgaccgacagcggcgcgcagcaggcgatcatcgcgcgccagtcgcggtacgcgaggaatacgaggatcaggatcgcgccgtacacgtacagcatcatcggcagctcgcttcccgcgacctcctcgttggtcgccgccagcacgcccgcgttgccggccgcgagccgcacggcgatacccgggaacggatgcgacgcgcgatactgcttcacgtcgtcgaggatgcggttgatcgtcgtcgccttgtggtccgtcaggaacaggtgcacggccgacatcgtgcagtcggccttcatgaagcccttcacgcgcccgacgtcgaccgataccgccccgtagttctccgggtcgatcggcaccacgctcatcttcggatagtcttcgttgtagccctggttgtagccgcgcagcatgcccgagtacgactgcacggacaccacgcccggctcggtgcgcatggccgccgcgaaatcgtcctcgtacagtccgaccgccgggttgttgcagctcttgccggccgactcgatcgcgaccgtcagccagtcgaggcccatgtcgtagttgccggcgatggacgtcgcgtcgcgattgaagcgtgcatccgcgcgcagttccggcgcgcccggctgcagcgtgccgatcacgcgatcgcggctttgccacgcggccagcgcaaacacgaccagcgtcagggcgaccgtcgcccccgcatacttcggctgcgcgacgcgcgcaagcggccgcagccatgccgagcgccgctcgccgcgcttgagcgcactgtccgcgtagcgcttcgtgaagttgaagcaggacgcggccaccggcagcaggatcaggttcgtcacgatcttgtacgccacgccgagcgacgcggtaatcgccagttcgcgcaccatcgggatcgggatcagcagcagcgtgatgaacgacacgaacgcggtgatcagcgccagcacgcccggaatcagcagcccgctgaagctgcggcgcgctgcctcgtacgagctgtgcccgtgcgaaatctcgcgcacgatgaagttcacctgctgcaccccgtgcgacacgccgatcgcgaataccaggaacggcaccagcaccgcgagcgggtcgaggccgaaacccagcagcttcagcgtgccgaactgccagaccagcgaggtcagcgagcacgcgatcaacagcaccgtgaagcgcagcgaatggcaataccagtacaccgcgagcgcggtcagcagcagcgcgatcgcgcagaagccgagcacggccttcgcgccgtcggcgatgtcgccgatctgcttcgcgaagccgatgatctgcacctcgtagccggcatcctcgaacggctggcggatcttctgttcgagcaaatgattgaacgcgacgtaatcgagcaccttgcccgcactgtcgcgctcgttcagctcggccgtgatcatcgcgctgtcctcgccgtgcgacacgagcgtgccgacatagccgcccagcgtcgtcgcgcgacggatcttcccgacgatctccggcgtcagctggtccggcgtgatcgtgccggaaatgatcggctccgcgcgaaagccttcgttggttatttcattgacgaacgcattcgacgtccacagcgagcgcacgccgatccggtcgacattcggcaggtaggtcaccgcctgcgtgaccttgtacaaccgtgtcagcccgtccggcgtccagatcgagccgtgcttcgcgcgcacgacgacggtgatccggttcgcgccgagcaggtcgttccggtattgctggaacgtgcggatgtactcgtggccgatcggcatctgcttctcgaagccggcatccatgcgcagttgcatcgcgaacacggccatcacgacggtgaacaggccgatcgccgcgagcacgatcgcgcgatgaccgaagaatagcctttcaaggcggctgaccagacgattgagcactgctttaccccttcatgtattccggcgatgcccgacgcgcgcgtcagaagttccgggtagcaaacacaccgacgaaattgcggtccgcatacggattgcccaccgactggtgaccgccgaagaacgccgcgaagttgatgcctgcctgccacttcggcggattctggttgaacagcacgtagacgttcaccgacttcgcaccctgcatgtagttcgcggtgaaggtcggcgtgtacccgtagaggccggtgctgaacgtcacgcccggcgtcacctgccagccggggatcagcgaaccgtcatacgtccagttgaagtcgaccgtcgcgcccaccgaactcgacgtgccctgcccttgcgtgatcggatagccgagccccgagttgttgttcagccacgggaaataaccggcggccggcacctgcgtgatcggctgcccgtccaccgtgcgcgtcacgtccgaaccgaggcccgggtagtagatccacgtgagttcccaggtcaacgcagcggaatccgcggcgatcagcttcaggaacgggtactcgctgcgcgtcagcgcgagcagcccgttgacatccagctggaacttcttcttgtcggcccactgctggcagttgacgccttgcacgccgttcgtgatgaggtcggtcgggccgcccgcgccgtagcagctcgacaacgcgaccgcatcgcgcggccgatacgacagctcggtaccgatggcccacgggccgaccccgaagttcgcgctcgcgccgaacagttgccggttctggagatacgaccattgcgcggtgccgttcgacagcgtcgacagcaccggcgacttgtccgtgtagttcaggtagtagaacgcgaagttcgcatcgaacgagcgcggcgagtaattgaacttcacgccgaactgcggccggtatttcgcgggcagctgcgtcgacaccggaatgccgaggtcgttgaacggcggcccggcgaacgcgccgttcacgagcccgttcttgatcgcattcagcgtgtcctggttgcccgccgcggccccgccgccgatcgcattggcgatcgtgccgacgcccgggccagcgacattggggttgttcgcgttgatcgtgaacggttcggcgccgcggccgatgacgttcgccagcgaccagtacgaaccgaccggcggaaggcggttgccgttccactggaactggtaatacgcttcggtgctgaagccgtgggaaagatcggcggcgaggctcagcatcggcgccggcagcagcgcctgcttgagctgcgaacccgggatcagcagcttctggacgtcgatcgagttggtcgcgttgatgccgctctgcgcgtagatgctctcgccccagttgatcacctggttgccgagccggacgtgcgcgttgcgcccaccgatcgtgaaatccttctgcgcccacagatcgagcagctgcgcgttgtacaccacctgcgcggccgccgtgctcgacagcggcgttctggccgttctcccggcgaggaagtcgtacatgcccgtgccgcgcaccatgaacttgagcccttcgcccggcatcttcagcagcagctcgctggtcgcgctcacgtaggtgctgaacggctgccccttgcggtagttcaggtcgccgttgtcaccgtaaccccactgatccgtgttggcagccgcgccgcaaccgtatgcattcggatcgccggtcagcgagcagctcggactcctggtccggatcccgccgcccgccgtgagattggtcacccacgacccctgaacggcgccgtctcccagcgtgaactcgtacccgtacgcagtcgacgttgccgcacccagcatggcaatcgacaccgtagtactcttaacgatattgcttgctttcatcgcaccacccacccatctccagaccggatgccgacggcgcgagtgcgcacgtcgggcctgttttctattttttggctacggcaatcagcgttcgctgaccgatctcagcgattccgccgagtagaaatcgggcttgaagcgcggatcgttgatctcctggtaccagcgaatatccttgccctggccgatcgtcgacgaatcgaacacgtaacgcccgctcagcacgtcgtactgcgccatcggttcgttgtcgcaggcaccgcccagctcccataccggaatcgggtagctctcgcgcaccttccacagcttgccctgcgcgtcgtagtcctcgccgacgagtgcgagccagctgtcctcgtcgaggtagaacaccttcttcgacgcgacgtggcgcgcactcggcttgaccgtcgcctcgacgacccatacgcgatgcatctcgtagcgccggttcgccgacgcgatgccgtccggggtcgcgacgtcgtgcagcttgctcttgaacttgtacatgccgaacgcgttgtacggaacgagcaggtcacgcttgccgacgagtttccagttgaaccggtcgatcgagccgttgaacatgttggcttcgtcgatcaggtactggttctcgaagccgatcagcggcgcgtcatgcgtataggccggcatgcgtctcacgcggcgctggcccggaaagtagtagtaggtttccgagtccttgttgaaatactggcgctgcacgaacgcctgccccgccagcgcggccggtgacgtggccgagaaataggcggccaggctgagctggtcgacatccttcggcccgctcttgcccgatttgcccgacggaaaaagaagacctgcgggccgatcccgtcgatccattcgccgccgcccggacgcggtgagatcgacgtgacgaccagcggccactcgataccgacaccccgataccggttctcgtagttcaggatcgcttcggcgccggttttcggctgggaaacagcacgccgggcaagacgcccgtttcgagcgtctcgccatccgacgcgagcttcgcggccgtgaggttggccttcgtgttctgctcggcaaattccggcagctggcactcgcggtgcgacggatagacatccatccggtagcccttgcgctgcttgaccaatgcgatctggccgggcgacagattgctcgcgtacttgtcgacgttcgcggcgtcgatcgaataaagcggcttctcgttccggtgtttccagaaatcgcctcgcgtcttgccgtattcccagcccgactgcggctcctgcttgccggaaaaggccggaatggaaccgtccttgctcgcgccgcgttcggcgcctgcggaggtaaggtcgtcagccaccgcgctgcctgccatcaccagaaacgcagccgcgattgcggacacggttccgatcgtgtgcttcttcatcatgttctccttccgagactcagctttcattcaccggttgtgcggttgacgggcgacaggcgttcaatccgtttcgagcggctgacacgccgcttcccggaaggccgtcgcgcgacctccgcgaccgtgaaacgctcgacatcaccgagccgatgcgttctacgttgtaagtaatgcgaaatattgtcggtattcttccgccgaattccgcggcgtctaacaccctcttgcgtcgacgccgcgccggtcgcgcgaacggccgggcgtccgcgtcaggcggcgccggatccggccaccgccaccgcccgcacttcgacacacagctcgggcaacgcgagctgcgtcaccccgaccgccgtccacgacggatagcgatccgggaagtattcgtccttcacggctgcgaaggcttcaacctcggcgcgcagatccgtatgaaaagtcgtcagttccaccacgtcggcaaggctcgcgcccgcctcgaccagaatcgccttcagcgattcgaacgcgatgcgcgcctgcgcctgcacgccgtcgcccggccgcatgtccgcgccgatcccgacctggccggaaacccagatcgtgtcgcccacacgcgtcgcgggggcgaaatggtaggtgtcgtaccacgccttgaacccgggtggaacgatcggttgccgcttgctggttgttgccatgactggaatcctccggattcagacgagttgacggaagcacggcgcgcgaaacgggtcgcccgccttcaaggacgcgagctcgtccacgaacagcacgcccgccggcgtgaaaccggatgcgctgttgtccggcagcgggctgaacgtggcgtcgtcgccgaagaagcgcagtacgagcgtgtggcgatcgggaaacgccggatcgaccacgccgccgccgtgcagcacgccgggatgaagcagcaggacgtcgccgggcttcgtggcccacgagaggatgtcgtacttgcccggatcggcgcggcgctcggcttcgatgtccggcatccgcggccagacgccgccgccatgcagcggctcggtgggatcgtcggcgttctggaacgtggtgccgtcgtgacgcacgccgcgatgcgagccccggacaatctcgagcgcgttgcgcttgggaacggcctcgaaactgatccacgcgttgccgaagtgcgtcccggaccacggcaggtacgaggtgtcctgatgccacaacgagcgtgcgccctttccgccgcgcttcaggaacagttcctcggcgaagaaccacacgtgctccgatccccacaagtcggcaaacaggcgaccgagcggcagcgtggcgaccagttcgtcgagccgttccttcgcatacggattcgcgttgtcgacgtgcgaccggaattcggtaccgtcgaggagactcgacgccatcggccccgggttttcaatccccagtcgaacgcgagccggcattgggccagctgttcctcgttcaacacgccttcgatcagaatcgcaccgtcttccgcgaaagccttgcgcttgacatcgtccatcggtcacctcctgttggttcgcccccgccctgcttgcgggtgccttgtaccattccgaacatggaacagagtaacaatattaggtaatgatgataaagatagaagaaaataaaagagagggtattcccggtacggattcgatacgtggacaaaacgggatgcctggcatgcgaagccgatcacggccgcgtgcccgcccgcgcgccgaaagggcacaccgagggcacgcgccctctttcctccgacgattgttcgacggccttcacgtgtcgcggtcagcgccgagccgacaccccgccatccggaacacgccggacaacgtgacatgcaggccatcgccggatcgatgtcgacaccgtccgacgaaggccagcggatacgcgagggccgatccgcactcgcctcgctccggaacaccgttgctcacgcgctcgatcggccgcggtgagtaacggaatagcggaagcgatgcggcgctgagcggcacgacggcacaacagccatctccggcgcatgtcgtcgatcgacgcgaatgctccgatgcgcgtcgccacgcgcttacgcgaggcgacgatccccgctccggttcgagccaaaccggctggcgtcatgcgtctgacctgcgcgctccagcgcgcaataggcgtaatacaccacgaccgtcaagtacgaccacgtcaccagcgcgaggacgaagaaattgagcacgacgttgtgctcgtctcccggtatcggatagaagtcgtagatgcacgcgatcgccatcgacgtcaccgccgcgacggtcgtcgtcgtcgcatggaaccgctcgcctgccgccagcagtttccgcacgaaacccgcgaggtagatcgtcagccacgcccatgccgcgacatagaaatacggctgcactttcgcgatcacgccggacaccagtacggcggtgccgacgatggagatcgcgaacagcgcgacatcctggcggcccgacggcctgtagccgcgcgtcacggccatcaggcccgcgacggcgacgagcggcatcccgaagccccgggaaaacgcatccaggacatgcgacacgagccccgagagctcgaagtgagtcgcgaagtagatcagcgcgttggtcgaagagaccgtgacgatgagccactcgatcccgagcaggaaattgcgccgcttgagaaacttccagccgtaagtggccgtcgtggttgccagcaatgcgctggcgaggcaaagtgcgagcgttctgctgtccatgatcaaatgctccattccgattgcatacggttcatcattccttctccggattcaaactcgccaggtactgagcaacggcctcgcggtctttcggcgacagtgcggcggcgacgcgctgcatcgtgccggtcgcttccgttcgcgtgccggctgcaaacgcctccagttgcttcagcagatagtcgtgcccctggcccgccagacggggaactgcgcctggcccatcaggcgggcgccgtggcacgcggcacacgcccccttctcgaccagttgcctgccttgcgccgcctgttgcggatcggcctcgaagtagcggttgctgcgggccggctggcgcgcgtagtactcggacagcgacttgatttcggtctcgctcaggctcatcgccagcggcgccatgttcggattgacacgcttgccgctcgcgaagtcgtgaagctgggccgccacgtaggacgccggttgccccgccaggctcggataaccctggtcggccgacgtacccttgacgccgtgacagccgaggcacgtgtcggtcaggtgcggccacggtccgccgtcggcgcggtacgcctcttccgacgcggacacgaactgttgaaggcggtacagattcagcaacgtcggcccgaagacgacgagcgatacggcgacgagccccgcaatggcgagcaagatgcgtttttcatgattgctctcctatgcgcggcgcaggccgttcagtgcctgcaaggcgccctgatgccccgaacgcacggcgccatccatgtagcccgcccagatgttcgcggtttcggttcccgaccagatcagattgccgcacggcaaatgcagtccctcgccgtgcgcagtccagaaaccgggtggaatcgcggacacgcacgtgatcgtccatgggtcggcgcggctccagtcgtggtcgtgatacgacacgggcgacaacgcgtcgtcgccccacgcctgtgcatagatgtccgtgaggatgtgttgcgcggccttccggtccgtcggcaacagcgcgtttcggacgaacgcattgatgatcccgatctcgccgccgggcgggagttgtcgtacgcccagatgatcggtccgccgacctggaagacatggccgttcagccccttctcccgccagaacggacggcgatagaccatcgccgtcttgcgcgccggcgagtgggcgggccacgcacgctgcagcgacgcccgcttctcgggcaacgccggctcgaactgcacctggttgcagagggccgggtggatggccatgatgaccttgcgcgcccgcacctctccgcgatcggtatgcaatgtgacgatgtcgcggtcccaaccggagatccgtcgcaccggggtcgacaggcgcaccttgtcgcccagttgcccggccatcttcgtgcaaaggatctgcgagccgccgacgaagcgcgtttcctgggcgctgcgcttgatggaatcgagttgcgtgaagtcgcaggacgccgaattgatcatcgacaggaagtgcagcagccccatactgaccggcggagcgccgccgctcagcgtgcacgagccctcccaacccacccggtcctcgggcttgatgtcctgcgtcgccagccagtcgcccaccgacatcctgtccagctcgccggcccggggcgacgtccacggcgcgcccgacggcacgtcgcgcgacatcttgccgagcttcgacgatatggcttcgtcagtgccgaacgtgcctttcaggtcgaccgttgcgcggccttcgccgccgaggatgaccgtcttgccgtcgtagtaactcgggaacgtgccgacctccagttcgcgggcgagatcggcgacggcggtctggcccggcccgatccattggccgccgacctcggtgacaaatccgccttccacgttgtagttgagtgtccggccgccgactcggtcgcgcgcctcgagcaccacgaacgattcgcaaccggcctgtcgcaagtcgcgcgcggccgtcagtccggccagccccgcgccgatgatgaccacgtcgagcacgtcgaccggcatgccggacgtgccgccttcgccggcgctcgcctgccgcgcgccgatcgcgagcgtgcccacggcggcggctgacgcacccgcgtacttgagccactgcctccgacgcaaatcggctgctccattggggaaagacttctttggcatgttgtcttggctactgcaatgaaagtcgctcgggagccgtccatcaggatgacgaacgataggcggcccgttcggcacgtcgttccagaccgatcggaatgcggccgctgctcccgcctcactcatggcgcagggcaagtcggcgaaccacgcaatccatttgtaggaatatgtgacaaacgtaggtcatgatacatacaaccaaaataaagaaaagacacgggattaccctgccttggagaattttttggcggttgcagacgctgctgcgaagcagaccattcatcgcgggaatgccggccgattcacaaaataaacttcagcgtgacgcacgtgcccgctatgctcgcggtcacgaattcacgcgagaaatcgcatcggtccggcggcgatggcatcgccgtacggcatccacgcgccggttcacggcaacccgtgcccggtagcgactcgcgcgtgcgccgtggtgcgcgtgccgttcaatccgattccccgtgtcgtcgacggggcatggcttcatgggaacaggaatgccgggcgcctgcgcggaaatacccgtcgatatctcgtcgcgattcaacgtcctcggctatccgaacggggttatctcacgaggctggcggccgagacgcttgcccgccgaagcgcgcaccccgacctgttgtcgatcaacgcgagttttctcggccatcccgtttccagccccgcgacggcccgcatcgtcgaattgagatcgatgaaaagcctgtcgcgcgcgacgttgtcgctgatgcaggaaagcgcactcaaggcgctctacgtggcgacgttcaccgacttttcgcagacaactggcgccacggcgacgcattgcgcgggaccgcagctgccggccacgctttatcgcgcgtgcgtgagcatcgacacgctggcgatccccgatccgatgcactcgttcatctcgcagttcgacctgcgtctcgcacccggagcattgcggaacagcgagcctgaacacaccgcgatcatcgatggatggattgctctggatgacgaagcatcgccgacgctcgcgtcgttggccttcttcgccgatgcgttcccgccgccgagcgacaacgtcatcgatcgcgccgagtggggatcggtgccgacgatcgactatgcggcacacctcaaggccgctcccgcccccgggccgatccacgcccgcttcgtgacgaaggacgtccgcaatggcctgctggtcatcgatggtgaattgcgggatacgagcgggcagctcgtggcggagtcgcttcagctcgcgaaattccgcggaacgctcggcgacacacgtccggcaagccgaatgcccgccctgtgcgtcgccctcgccggacgtggcgcccgccacgcggcatcatgcgcgcggggcaaagaaaaagacagggacatgccctgtcttcctgtgtcacctggctgggccgcgactgctaccggctcttgccgccgggcgccttgctctccaccagggagtacgccgacgccaggaacctcgcatcgagcccctccgtctgccgccccatcgtgtactggagcgccagcccgtcggccatcgcgacgagcagcatcgcgacgtgctcgccgtcggccgccttgaggcccggattcactgcacggacgagcgcggcgatggcttgcgtcaggatgcataccattcgtcgatcagccgcgcgcattcgggatcgatcgacgcaaacgaaacgaagtgggcccacagggccgtgcccttgacgtccttcgcattctcgagcgccatgccgagcaatgcctcgagcgtttcacgcggcggcgcgccgctttcgagcgcgcgcttcagcgcgctcaggtacgcctcgatctcgggctccatgactgcccgcagcacggcaagccgcgttgggaagtagtactggaggttgctgacgctgatgccggcgcgctgcgcgaccgcacgctgggaaaactccagcgcaccgccctcgagcaggagtttcctcgccacgcgcacgatgagtttgcgcgtacgaacgccctgggcccgaaggccttcaggctgcgcgccggtgggtccggcactcgacgtgcgccgtttccgggtcggttgctcaataggcactgtcatcgcttccgtcatgatccgggcgtttccgccctcctgatgtgataggaccggcgtttcgccggtcgcgaacgactatacccgatgccgacaccaatttccatccgggcgccgccgggcggcgggcggccgccgctgccaccgttcgtcgccgcgccggtgccgcgtgcgcggcgttcaccgtatcgcgaccgccggggccgccacgagcctgcacgctccgcccgggcgccgacgtccgcccgcgcgatcgcaacgggcagccgctccgctccccgcgttacctgacgctgacgccaccgccgccgcgcgcggcagacacgttggcgaggtagtacgcgacggcgcggatgtcgtcgctggacaacctggcgacagcggcatgcatcgcaccggccggatcggccggatcggcccgatcgttccgatacccggtcttgatggccgtgatctgcttcaccagatccgcctcgccgtgattcgcgaggcgcggcgcatgatccgtcgatgcggtcgcggccgcggcatgcgtcggtgcgatacccgccaggtaatgcgcgacggcccggatgtcttcgtccgacaatgcggcggccaccccgttcatcgcgcccgtctcgtcgtgccgcctgcccgcccggaacgcgacgagctggtccgcgagatacgcctcgccctgccccgcgaggcgaggcgcgcgctcgttgcccgtcaggcccgcgccatgacatgcgacgcagctcctcgtctgaaccaccgacatgccgcgcgcggcaagcgccgcgtctacgcggatcttctcgttctggaccggcgcctggcgcgcgaaatagtcggccagcagcttcatctgcttctcgtccattccgcgtgcaagcggccccatgtacgggtccggccggcggccgctggcgaacgcgcgcaactgggcctcgatataggccgccggctggccggacagcgccgggtatccgccgttacccgattgtccgcgcgggccgtgacagataaaacacgtctcctgcggctgcggccatgggccggcatcggccttgagcgtgtcggcctcgccgtccagcgctttcccgaagcggtaatagccgtacagatccggcccgaacagcacaccggccgccgacacggcagcgaccacgacaacaccgatgatccatgctcgcttcactcaagcctccgtcgtccgatgcgcgagcgcacccagaacctgcagtgcggcgcgatgccccgaacgcaccgcgccatccattgcaccggcccagatgtcggccgtctccgttcccgaccagatcagccgccccgccggcgggtgcaagtactcgccccacttcgtccagaagccgggcggaatcggatgaatgcaggtcagcgaccatgggtccaccttgccccagtcgtaatcgtggaactgcgtcgggcgcagcgccttgtcgccgagcgcctgcgcatagatcgcggaaagcgtccgttccgccaccttcgcgtcgctcgcgagcgcgcccggtgcgatgaagccgttgatgacgccgatcgacgcgtccggcggcgagttgtcataggcccataacagcgggccgttgaccgggatgacctgcccgttgcacccgtcgtcccgccagaacggccggtcgtagacgtgaaccgtcttgcgcatcggcgcgtacgcgggccacaggcgctgcaactgcgcgcgaccgtccggcagcggcgggtcgaacacgacctggttgcacagcgccggattcaacgcgacgatcacgcggcgcgcacgtacgacaccctggtcggtatgcagctcgacgacctcgcgattccagccggcaatcctgcgcaccgggcaggacagcttcacccgttcgcccagttcgtccgccatcctgatgctcagcacctgcgaaccgccgacgaaacgcgattcctgcgcgcccccttgatcgactcgagctggtcgtagtcgctgttcgcgctgttgatcgtcgccaggtagtgcagcaagccgagctgcgccggcgccgtgccgagcgacagccgggccgccaggctgaacgagaatttctcctcgttggtcaggccttgctgcgcgagccacgcgcccagcgacagcttgtcgagcgccgccgcattcggcgctttccacggtgccgccgaaggcacgttcttcgccatcgcgttgagccgggccgcgatcgtgccgttgccgcccaccgtaccctgcgtgtcctgggtcacccgcgcgccgtccgccagatacaccgtcttgccggcgtagtacgtgtcgaacgtatcgacgttcagctcgcgcgcgagatcgacgatcgccgtctggccggggccgaaccactgcccgcccgcctcggaaattctcccgccgccgaggtcgtggttgtaggttcgcccgccgacgcgatcgcgcgcctcgagcacgacgaacgattcacatccggcacgcttcaggtcgcgcgcggcggtcagccccgcgagccccgcgccgatgatcgcgacgtcgagcacgccgtcgttcccggcgactgcgccggccgcttgcgcgagcgacactccgccggccgcgagcgaccccgcgcccaccgctgcgaggcggagcaggttgcgccgggtctgggcatccggcctgggtttgcgattcatttttatgttccttccgtcctcgtcagtttgtccttgcaccggtacgcggcgagcgcgcggtcattccatcgtctcgtcgcacgggctgctcgcgaacacctgcgccaccgccgcgtcgacccatgcgtcggtcaggtgccaccgtccgctcgcgccgtccggcaacacgtcgtcgcccagccctgtcaggccgagcgtcagcaactcgatcggcaacggcaaccgcacaccggcgcacgccaggctccggcctcgctgctcgttcaggaatgcagcgaattgaacgcggaacgacgggtcgtgcacggacaggagcgccgcttccatccacatgacgcaggcgtccggctgccgatagcgttgcctgacgtacgcgtgcatcgcgcgctccatcacctcgcggtcgctggcggcctcgacgacgcgcatcagttcacgttcgacgccttcgtgatcgcgcctgagcaactcgagcagcacggccgtcttgtcgccgaaattcgaatagaacgcgccgcgcgtatagcccgccgcgatggcaatgctttcgatgctcgccgccgcatatcccctttcggcgaagatcgtgcgtgccgccagcagcagccgctctcgcgactcgccgtcgcgtttcctgccgcgccgcggcgtcggcttcaccgcctgtccggcctgatccgtgccgtgagtttcatgcgcttcaagaccctcattcatctcaggattcctatttgaacgaggtaaattcacgccaccggatcatgccggcggccccggccgtttcgacatgacgcttccgttcgagcgcgcagtacgcgtaatagatcgcgaccgcgaaatacgaccacgtcagcagcgccagcacgggaaaaccggatacggcaccgtgcgcatcgccgggcagctcgtacaggtcgtcgacgtacgcgacgaccagcgacagcacgagcgccagcgccgtcgtcatcgcatgcaacggttccccggcgcgcaacagccgcgcgacgaaatagaccagatagagcgccagcaacacccacatcgccacatggaaatacggcaggacgacatcgacgaactcgagcgtcatcagcgccatcgttcccaccagggccatcccgagcaacatcacgacctgctgggccatcggcctgtattcgtgcgtgacggccatcatgccggcagccgcgatcaccgggatgccgaaccctctcgtgaacatgtccaggaagtgcgccacgccggacgagcctgaccagcccgtcgccatgaaaatcagcgcgttgacggcggacgccgcaacgacccaccaggcggccccgagcaacgggttgcgcatccggacgaacttcatgccataggtgcctgtcacccacgcgagcaaggcaacggacaacgcgatgtcgggagatctgaaatccatcatgaaacttcctgtaccgattcggttcgatgcttcgttggttctccggatgaacgctcgcccgacgcgatggcgcacgcccatcggtgtgctcatgcttcctgttcgaaccgtcggcgcccccacacttcttcgatccttccgccgaaccccgccggatcgagcgggacagggcattccgcttatagaaaacgttgaccattgtaggtcatgatacataacaattgaacacgaaaaagcagggtattcccctgcctcgaaatcacctggatcgcgggaagcatcgggcaatcagcgggcgccaaccaacggcgcagcacgcctgacgacccgcgccgcgccgcaacgccggtggcgatcgcatcccaacccatgccgaaccatcgtgtcgtccggtggccgatttcgtgcggtaacattgcgattcgatggcgtgaaatagcaataagacaaagcggacaccatgactgaagaatccataccgtcccgcgcgacgcgcgccgccgccctccgcgccacagcggcagcccccggccggcacaccgctcgcgcgcccctgtcatgcccctccccgacgccaacgcaatccgaccgcgccaccttcccgtcgtgaatcgacgcaacaccacgcttgggagcacgaaatgaagcttgagggctgagccgcaagattgcggtatcgatgacggagctggcactcggcatcacgttgatcgtcgtgctgatgatctatgcgttctactacgtgatgctccggcactggagcgaggtctgcaatcaggcgggctggtttccgtcgaaccccgagtggatctggctgggcatcaccatcgtgaccggcctggcactcgcggtcgtcgtgtcggctcggctcgcgcaccggattctggtgccgctcaactccgtcgcggacagcattcgtcgcgtcgccaagggcgacctgaccgcgcgcgcggtcgccggcgatcgatcgatgcgcgaagccgcgctgatcgcggacgacttcaatgcactcgcggcccagctgcagcgcatgacggacgaacaggcattctggaatgccgcgatcgcgcacgaactgcgcacgccggtcacggtcctgcgcgggcggttgcaggggctggcggaaggcgtcttccagccgggcgaggccctgttccggagcctgttgacccaggcggaaggactgacgcgcctgatagaggatctccgcgtgatcagcctcgccgaaagcgggcatctgagcgtcagcatccaggagaccgatctcgcgacgcacatccacgcggtcgtcgagatgttcgaggatgcactgaccgcggccggccagcacatggtgctcgatctcgatacgcggcccatgcgctgcgacccgttccgatgcgccaggcgctgcttgcgctgctggagaacgcgcggcgctatgcggtacccggcgcgatacgcatccacacgcgtgtcgaaaacggcgcgtgtcgcctgctggtcgaagacgagggccgggcatcccggccgattgcgcggcccggattttcgatgccttccggcgcgtggacgacgcgcagtccagccagaagggcggcagcggcctcgggctggccgtggtcgcggccattgcgcaggcgcacgacggagaggcatcgtgtcgcccgacggcacacggcggcacgtcgtttgaactgcgctggcccgacggccccgcatcgccgcgcatcgcgacgccgaaccggaaggacgtgacgtccgctacgcaacgctccgtcgatgccgatccgtgctgaatctcccggcgagccggcgacacgccccgtgcgccggcctgccgcccgcgcgcctcgcgctcacgcccgccaccgctgaacgggcagtgcgcgtgcgtcgcgcgatgtgcccgccgcccgcgccgaagcgatcttcgcaataatggcgcgcggaacgcacggccggcgcctccgccggcatgcacggccgtcgccatttcatcggaggattgcggatttcccgcgccgcccatcccgcttccgcacaccgccgggtcctccgaaagcccgccctccgggcccggcccgccgccgcatcgccgttccgcgattctttcgccgcctccatcaaacctccatctttccgcacaaaaactccatcgggcacacgcacactgcgaaccgaaaatgcgggccatcgggtgcctgcgtcccatggagtccacatgaagaatcagaaacgagcctgctacggcgccgtgtgcgcgctggtggcagcgatgctggcgggctgcgggccctccgaacagcaggccgccgcgccggccatcccggtggcggcgatgacgctcgcggccgcgccctcgacctgaccgaagacctgcccggccgcgtcgcggcgcaccggatcgccgagatccggccgcaggtcagcggcatcgtgcagcgacggctgttcgagcaaggctcggaagtgcgcgcgggcgagccgctgttccagatcaacccggcgccgttcaaggccgacatggacacggccgcggcggccctgcaacgtgcgcaagccgcgctagaacgggccaaggtgcagaccacccgcctcaagccgctggtggaagccgacgcgatcagccggcaggtctacgacgattcggtgtcgcaacgcgaccaggccgccgccgacgtcgctcaggcccgcgcgacgctcgcgcgccgccagctcgacctgaagttcgcgaccgtcgaggcgccgatcacgggccgcatcgaccaggccctcgtgaccgagggtgcgctcgtcgcgagcagcgacagccagccgatggcacgcatccagcagatcgaccaggtttatgtggacgtccgccagccggccgcgtcgctcgattcgctgcgcggcgcgctcgccgggcagccggacaccacggcaaacgggctgccggtcgacgtgctgcgcgacgacgactcgcgctacgacgtgaagggccgcatgctgttctcgggcgtcaacgtcgatccgggtaccggtgacgtgctgctgcgcgtgctggtcgacaacccgaagcgcgagctgctgccgggcatgtacgtgcgtgcccgcatcccgcgcgcgcactacgccgatgcgctgaccgtgccgcaacaggcgatcgtccgcgccggcggcaaaccgcaggtctgggtgatcgacgcgaagaatcaggcgcacctgaagggcgtcgaagtgggcgagctgacgcatcgcagctaccgcatcaagtcgggtctgcaggcggggcagaaggtcgtcgtcgaaggcatggagcgcctgagcgacggcgcggccgtcacggcgaccgcatggaagtcgcctgaagcggtcaagaccgctgccgcgcactgagtcacgggagcctccagtcatgtcccaattcttcatccggcgcccggtcttcgcgtgggtgatcgccctcttcatcatcctgctgggcctgatcgccatccccgaactgccggttgcgcgctatccgtcggtcgcgccgccgaccgtcaccattaccgccacctacccgggcgccacgccgcaaacgatgagcgacagcgtgctgagcctcatcgagcgcgagctgtccggcgtgcgtaacctgctgtacttcgaatcgtcggcagatacctccggccaggcgaccatcaccgcgaccttcaagcccggcaccgattcggcgatggcgcaggtcgaagtccagaacaagctcaagtcggtcgaaccgcgcctgcccccgtcgtgcggcaaaacggcgtgatcgtgcagtcggcctcatcgggcttcctgttgtttgtcggcctgaagtcggaaagcggccgctacgacgaaaacgcgcttgccgactacatggcgcgcaacgtcgtcgaggacttgcgacgcgtcgaaggcgtcggcaaggtgcagctgttcggctccgaacaggcgatgcgcatctgggtcgatccacagaagctgatcacctacggcctgtcgatgaacgacctgacgacggccgtcagccagcagaacgtgcagatcgccccgggcagcctcggcgcggcgcccgcactgccgggccaacgcgtgacggtgccgctcaccgcgcaaggccagctcacgtcgccggagcagttcgcgaagatcgtgctgcgcgcgaatgcgaacggctcgaaggtcgtgctcggcgacgtcgcgcgggtcgaactcggcccgcagtccttcaccttcgtcaacagcgagaacggcaaacccgccaccttcgccggcgtgcagctggcgccgggcgccaacgcggtgaagaccgcggaggccgtgcgcgagcaactcgacatgatcgccaagaccatgccttccggcatgacctactcgatcccgttcgataccgcaccgttcgtgaagatctcgatcgagaaggtgattcacacgctgctcgaagcgatggtgctcgtgttcctggtgatgtacctgttcctgcagaacgtgcgctacacgctgatcccggcgatcgtcgcgccggtggcgatgctcggcaccttcacggtcatgctgatgactggcttctcgatcaacgtgctgacgatgttcggcatggtgctcgcgatcggcatcatcgtcgacgatgcgatcgtcgtcgtggaaaacgtcgaacgcctgatgatggaagaaggcctgtcgccgaaggacgcgacgatcaaggccatgaaggaaatcaccggcgccatcatcggcatcacgctggtgctgacggccgtgttcctcccgatggcgatgtcgagcggctcggttggcgtgatctatcagcagttcacgctgtcgatggccgtgtcgatcatgttctcggccctgcttgcgctcacgctgacgccggccctgtgcgcgacgatgctcgccggtcgaccacagccatcaccagaaacgcggcttcttcggctggttcaaccgtcgcttcgaccgcctcacggactggtacgaaacgcgcgtcggccgcctggtcggccgcacgggccgcgtgatgctgctgttcgtcgcgatcgctgtcgcgctggtgttcggcttccgcgtgctgccgtcgtcgttcctgcccgaggaagaccagggctacttcatgaccggcttcctgctcccggcggattcgaccgtcgagcgcacgggtgacgtggtcaagaccctcgagaagcatctcgcgtcgcgtccggcgatccagtcgagcatctccatcatcggctacggcttctccggcctcggctccaacgcggcactgaattacgcggtgctcaaggactgggacaagcgcgaaggttcgtccacgctggaagaagcgatgcgcgcgcaggccgcgacgggcggcgtgaccgaaggtacggtcatgagcctgttgccgccggcgatcgacgggctgggcacgagttcgggcttcacgatgcgcctgcaggatcgcgccaaccagggtttcgctgcgctcaaggcggctgaaaccaggctgctcgaactggccgcgcaaagcaaggtggtgaccggcgtctatccggacagcctgccggccggcacgagcgtgcggctggacatcgaccgcgagaaggccgaagcgctcggcgtgtcgttcacgaccatcagcgacacgctgtcggccgcgatgggctcgacctacgtgaacgacttcccgaacgccggccgcatgcagcaggtgatcatccaggcggatgccccggcacgcatgcagatcgataacgtgatgaaactctacgtgcgcaacgcgaccggcggcatggtaccgctgtccgaagtggtgcatccggtctggtcggaagccccgctgcagatggtgcgcttccagggttacccggccgcgcgtatctccggcagtccggcacccggttactccagcggcgcggcgatggccgagatggagcgcctcgcaacccagttgccgcctggcttcacggtggcctggaccggccagtcgctgcaggagcgtgaatcggcatcgcaggcgccgatgctgatggcgctgtcgatgatcgtcgtgttcctggtgctcgcggcgctctacgagagctgggcgattccgttgtcggtgatgctggtggtgccgctcggcctgatcggcgcactcggcgcggtgatgctccgcgggctgccgaacgacgtgttcttcaaggtcgggatgattaccgtgatcggcctgtcggcgaagaacgcgatcctgatcgtggagttcgcgaagcagctgcgcgaggaaggcatggggctgatcgaggctgccgtgcagtcgtccaggctgcgcctgcgcccgatcctgatgacgtcgctcgcgttcgggctcggcgtggtgccgctcgtcatcgcctccggcgccagctccgagacgcaacacgcgatcggtaccggcgtgctgggcggcatgatcaccgccaccgtgctggccattttcttcgttccggtcttcttcgtgttcgtgatgagcatccaggaacgcatctcggcatggcgcgcatccggcaagaagcccgccaccgtgacccacgaacaagaaggttgatgccatgcgattgctcattcttaccgcggccgtttccgccgccctcgcgctgtcggcatgctcgatggccccgaagctggtcaagcccgcgatgccggtgccgaccgcctacacgaccgctgccgcggccgaccagcacgcgaacgcggccgatctcggctggcgcacgatgttcggcgaccgccgcctgcagcgcctgatcgagctcgcgctcgagaacaaccgcgacctgcgcctggccgctttgaacgtgcaggccgccgaagcacagtacggcatccagcgttccgcgcgcctgccgtcgatcgccgccggcgcgagcttcacgcgccagcgcacgccggccgactcgcaatcgaacccgccgatcttcgagacgacgcagaaccagtacggcgtgaacgtcggcgtcagcgcgttcgagatcgacctgttcggccgcgtgaagtcgctgtccgatgcggcgttcgcgcgctacctcgcgaccgatcacggccgccgcgcggtacagattgcgctcgtcggctccgtggccaacgcgtatttcgcggagcgtctcgcgcaggaacagcgcgcgttgtccgagcgcacgctgaacgactggcgccagtcgctcgacctcgcgcgccggctcaagctcgcggatcaggcgagcggcgtcgacatcgcgcaggccgaaggccaggtcgcgagcgccagcgccgatctcgaagcacgctcgcgcgccgtcgagcaggcgggcaacgcgctgcggctgctggtcggcaccgacctgccgaaaaacctgcccgacccgctgtcgctggaacgccagccggtgatgacgcaactgccggccggcctgccgtcggaattgctgtaccgccggccggacatccagcaggccgagcagaacctcgtcgccgccaacgccgacatcggcgcggcgcgcgcggcgttcttcccgcggctgtcgctgacgtcgtcgatcggtttcctgagcccggggctgggcagcctgttcgccggcggccagaacgtgtggagcttcgcgccgcaggtcacgttgccgatcttccagggcggccggctgcgttccgaactgaatctcgcggaagtgcgcaagtccagcgcggtcgtcgaatacgaacgcgcgatccagaccgcgttccgcgaagtggccgacggcctcgccgggcgcgagacgttcacccggcagatcgatgcgcaaaaccgcgtcgtcaagagcgccgagcgccgtaccgatctcgtgaacctgcgctatcgggccggcatcgaggaccggctggaactgctcgactcgcagcgccagctgtatgccgcgcgtcaggccctgctggatctgcgcaacgccgaactgggcaacgcggtcgcactctacaaggcgctcggtggcggactggtcgacaccgatgtgcctcccgccaacaacgtggcgaacaactgagcaacgcgtcgtcgccgatccgttcgcgacgcccgaacgcacggtgaagtccggcggcgcacgtgccgcgccgccggcccgcctgcaggtcacgttcactttcagtgataccgatgaaccctctgatactcattgccgaagacgatccggagatcgccgacatactcgacgcctacctggctcacgacggctttcgcacctatcgcgtcggtcacggccaggccgtgctcgacgtgcagcgcgtgctgaaacccgacctgatcctgctcgacgtcaggatgccgaacaaggacggctgggaagtcctggtcgaactgcgccgccgcggcgacacgccgatcgtcatcatcacggcgctcgaccgcgaaatcgatcgcttgcagggcctgcgcttcggcgcggacgactacatcacgaagccgttcaacccggccgaggtggtcgcgcgcatccgggcgatcctgcgccgtctggaaaccgccgccgcgggacgcttcatcaaggtcggcaacctcgaaatcgatacgcaaagctatctgaccacggtccgcacggacagcggggaaaccagcatcgcgctgacgctgaccgaattccggctgctcgcccacctggccggctcgccgaaccgcgtgttcacgcgcagcgaactgatcgacgcctgcctcgccgacgtcgatgcgctggaacgcaccgtcgacagccatatcagccggttgcgcaagaagctcgaatgtgcgggcgcgtcggggatgccggaggtgatgcgcggcgtcggctatcggctgcgaagcagccagtgagcacgcatcatcgatcgaggctgcgtgtcgcgcgaatcgtcgggctcctgacggttgctgtcgtgctgacggtcgcgaccggatggttcgtcgtctacggcctgatcctcgtcgtttcgtctcccgcgaccgacaacccgatcgcggtcgtgatccgggagacgccgagctatctggtgctcgccgccgtgctgctggccgggctggtcgcgacggtcgtcgacctcgtcaagctggcgcgcaggacgcgttcgtaacccgccgcgcgcattcgccgccctcgtgaaacgacatcgcctgaacctccgctacgcgcagcagatcgggttgcgtcatgcacgtctcgacgagcatgcgggggcaacggcttcgcgtcgttcgtcgcgcccgcttcgatggcggacatcgtgcacggcgctgctgcccattcgattcgtcgaaaggccggcgaacgatggcgctcccgtcgaaccccggctcgccattgccgtaacggatcgtgcgcgcgcggaaagccgccccggcaaggccgcgcggcggcctgcgcgtttcgatagcggctccatcgtttctccatcgaaccgcacaacaacgtccatcgacgccacacacactgcgaagcaagtcatcgaatccgcatgcgcgagccacccgaacacatggacacgtttccgaccctgatcgcctgcgagcattgcgacagcatctaccgacgccgcgcgctggcgcctcacgaggtcgcgcgttgcgaacggtgttccgcggtgctgtttcgatcgagctggctcgatatcgaccggtggctcgcgctggcggtcgcggccggcgtggtcttcgcgatcgccaacctctgcccgatcatgcggatcggcgtgcaggggctgcacagcgaagccacgctgtggcaatccgcgctcgcgctggcccacggcttcgccgcgccgatcgcgattccgacggccttcgccatcgtcgtggtgccgttcctgcagatcgcgacgctgatctggttgctggcctttgcccgtgcggggcgtcgcgcgcccgcgttcggcccgctgatgcggctgctcgtcgcgctgcggccatggagcatgatcgaggtcggattgctcggcatcctcatcgcgatcatcaagctgtccagcctcatgcagatcattcccggcgccggcctgggccacggccgtgctgatggtgctgatcccgctgatcgcggggcacgacgcacgccagctatgggaccgggtcgtgccggtggaacccgccggaggccacccgtgagcctgcccgtgcgcgccggtcagctgggcatggtcgggtgccatgcgtgcggcctcgtctgccgcgcgcacgcatccgccacaaccgacacccatccgcacgccgccgaaacggcacgctgcccgcggtgcgggtccgcgctgcacgcgcgtcgtccggacagcatcgtgcgtgcgtgggcgctgctgatcgccagcctgatcttctacatcccggccaacctgttgccggtgatgcgcaccacgctgctcggcagccacagcgaatcgacgatcctcagcggcgtcgtggtgttctggaaagccggctcgtacggcatcgcgtcggtgatcttcatcgcgagtgtcgtcgtgccgtgtacgaagttcctcgcgatcgccatgctgctcgtcacgaccggccggcgcagcgtgtcggccatgcgcgagcgggccgtgctgtaccgcgcggtcgagctggtcggctactggtcgatgctggacgtgctggtcgtcgcgatcatctgtgcgctggtgaagttcggtccgctgtccgagatcgaaccgcgcgccggcattttgtttttcggcatggtcgtcatcctcacgatgctgtccgcgatgagttttgacccacgcctcatttgggacgccgaagaagcatgaatcctgcatccggcccgcaaggcctcgaaccccacgacccgcccgtgtcacgcaaccgcatgcggctttcgctcgtctggctcgtgccgctcgtcgcggcgctgatcggcctgtcgatggtgatccacgcgtggttgtccgtcggaccggaaatcacgatcacgttcaacaccgcgcaaggcctcgaggccggcaagacacccgtcaagtacaaggacgtcgtgatcggcaccgtgaccgccatttcgctgagcgacgacagttcacacgtggtcgcgacggtttcgttcgtgaagaatgcgcgcaacctcattcgcgacgacacgcgcttctgggttgtgcggccccgcgtcggcatgagtggcgtatcgggcatcgatacgctgttctccggcgcgtacatcggcatggacacgggccgctccgacaaggcgcgcaaagcctacaccgggctcgaaacgccgccgaccgtcatcaacggcacgccggggacgagcttcgcgttgcgggccgccgatctcggctcgctcgatatcggctcgccggtctactaccgccatctgatggtgggccacgtcgcgtcgtacaagctcgacatgcacagtcgcgacatgaacctgcaggtgttcatcgacgcgccgtacgaccggctggtgacgaccgatacgcgcttctggaacgcgagcggcatggatctttcgctcgacgcgaacggcctgaagctgaaaacccagtcggtcgcgacgatcgtgggcggcggcatcgcgttcgcgacaccggaagacggcggcacgacggccgcccctgccggcaagctgtttacgctcgccgtcgacgaagccgccgcgatggccgcgccggacggcccgtcccagctcatccggctgcgtttcgaacagccgctgcgcggactcgcggtcggggcgccggtggaattctccggcatcgaaatgggcacggtcgtctcgacccggctcgacttcgaccgtgcgtcccggcgcttccagtccatcgtcatggtcaaggtctatccgtaccggctcgggcccgtcgtcgagaaactgcagaagaccgacggcaacggcaatccgcgcgcggcccagtttctcgcgggcctggtcgagcacgggctccgggcggagacgcgtaccggcaacctgctgaccgggcagctctacatctcgttcgatttcgtgaagaacgcgccgaaggtgccgttcgatgccaacgcgacgccgctgaccattcccaccgtcacgagcacgttcgacaagctgccggagcagatcgccgacatcgtcgagaagatcaacaagatgccgctggaatcgatcggcaagcacgtcgattccagcctgacgaacctggacgcgacgctcaggcaagtgaacggccagctgctgccgtcgacgacgcgcacgctcgaccaggcgaaccagacgttcggcgcgttgcgccagggtatcgccgaggacggtccgcttcaggaaaacctggcgaacacgctgaccgaagtccagcgtaccgcgcgatcgctgcgtacgctgacggacatgctgggccgccgtcccgaatcgctgctccggggaaccggggccgatcatgcaccgctcgcgccggccgacacttcaaccccgcctgtccagcaggagccacgacaaccatgagcttcccgattcgcgccaggacgatcgccctgggcgccggtgccgtcatcgcgctgaccgcgtgcgcgtcgaacccggtgcattactacacgctcgtctcgccggccacgtccgcgacggcgacggccgcgcgcggcaccgcgccgctcgcgatcaatgtgttgccggtcggcatccccgcccagctcgaccagcagcagatggtcgttcgcagcggcgcgggcaccgcggtgatactcgacaacgaacgctggatcgccccgctcggcgacgagctgcgcgcggcgctttcgtcggcgctcgtcgagcagctgggcgcgcgcaacgtcaccggcctgccgcgcccgtcaaaccagaccgtcatgagcatccgcacgcaggtgcgccgcttcgatgcgtggcccgggagccgggcccagttcgaagccgactgggtcgtcggcgtgcagcaggacatgccgggcccgcgcatttcgtgcagcacgcggctcgacgaggccgcccctggaagtcatgccgacatggtgcgcgtgcagcagcgcatgatcgggcagttcgccgcccggattgcgagcaccgtgcgcagcttcggcagcgggcgccccgcctgtcccgccgattcgtaaatcatcccgccgatggaagccatccatgggagcgcgagaagggagccggttatgggagccggctaccttgacccttgaacctttgaagcgatgctttacgcgcgccgccggtaagtacccggcgtgctccccgtccagtgccggaacgcgcgatggaacgcgctcggatcgtcgaagccgatgtcggcgccgatcgccgcgatcgtgtcgggcgtgtcggtcagccgctggatcgcgatgtcgcgccgcagttcgtccttgagcacctggaacgtcgtcccttcggcggccaggtggcggctcaacgtgcgcaccgagcaatgcaggtgctcggccgcctggtcgatcaccggcaggtcgggcaacgcggccgacaggtattgccgcacgcgatggcacacgagctgttcgctgaacgattcgaagatccagtcgccgggtgcgcgcgcgaggaacttgcgcaggttgcgcttgctctgccggatcggcgcatcgaggtagtccgcgctgaagcgcatcagcgtgcgctcgcagtcgaacgccacggagccggtgaagaaatacaggtggtcgaccgcatggcgcggccgcgggcacgcgaactcgatctgcagcagcgggatcttctgcccgatcagccaggagcacacgccgtgcacgagcttgagcatcagctcctggccgagcgcgccgatcgggccgatcgcgtcgttcgggcgcagcagcacctgcgcgacgaggccgtcgcgcttcgattcgacgaagaaatcgtcgagcaggatatggaagaattgcccgaaacgatactgcgccgtttcgaggttgcgcgcgtcgagcaggctcaggcacaggtacttcagcgtgccgccgcgcagcgggcgcgagaagatgccgggcatctcgtcgtcgaggtcgatcgcgagcgtgcggtacagcgtcgagaactgctcctccgtcacgcgcgcatgcggttcgccgagcagctcgatcgggatgccggccccgcgcaggtagcgctcgaccacgtcgcgctgcacgcccgcgctggcgaggaagccgttgacgagcgagatcggcaccgtcgcgctcggcgaaggcagcgcccgcccgggcccgggctgggcggaaagtgcatctgaaccggtcatcgcgtccccgtcggtcgaaccgctcgcattgtacttgagcggcccgcgcggggccttccgggcccggggcgcgccgggccttgcgcgacgcgccgacgccatcagtcggtgcggctgagttcccggcgcaggatcttgccgacggtcgacttcggcaggcggtcgacgaagcggatcagcttcggcaccttgtaggccgcgaggctcgcgcggcaatgcgcgacgagttgttcctccgagacgtacgcatcctgcgccagcacgacgaacagcttgacggcctcgcccgtgcgcgcgtccggcacgccgatgcacgcgcattcggcgacgcccggcatggcggtcgcgacggcttccacctcgttcgggtacacgttgaagcccgacacgatgatcatgtccttcttgcggtcgacgatccgcaggaaaccggcttcgtcgaacacgccgacgtcacccgtgcggaaatagccgtcggccgtgaacgcggccgcattcgcgtccggtttctgccagtagccgctcatcacctgcggccccttcacgcagatttcgccggcttcgccgatcgcgacttcgcgatcctggtcgtcgagcagcttcacgtcggtcgacggcagcggcaggcccgtggtgcccgtgaacgtgtcgatcgactgcgggttgaacgacacgaccggcgacgtttccgacaatccgtagccctcgcggatgaagttgcccgtcaccgccttccagcgcgacgagatcacgtcgatcacggccgcgccgccgccggccgacagcttcagccgcgaccagtcgacttccgtcaggcgcggatggccggcgagccccgcatacagcgtgttcacgccgacgaacaccgtcggccgcgcggccttcagcacgtcgatgaagccgtccatgtcgcgcgggttcgcgaccagccagttctgcgcgccgatcgcgaagtacgacaggaagttcaccgtcagcgcgaagatgtgatacatcgggatcgccgtgacgacgacctcctcgcccggctcgcgcgcggccggcacgatcgcgccgaactgcgcgatgttcgcgacgaggttgcggtgcgacagcgcggccccttcgacaggccggtcgtgccgcccgtgtactgcagcagcagcaggtccgcgccgccgagcggcaccggctcgaacgcgagcgattcgccggcggcgatggcgtcggcgagcgggatcgaaccgggcggcagcgcgtcgcatgcaccggccggcgcatcgacgacgccaagatcgccgcgcccgacgctcagcacggtgcgcacgcgcgtgccgccgaccacctcggcgaacgtacccatcgacccgccgcacaccagggcgacttcgacgcccgcgtcgttgagctgatgctcgagctcgcgcgccgtgtagagcgggttcacgttgacctggatcgcgccgatcttcgcgaccgcgacgaacgcgaccggaaacgcgagcacgttgggcagcatcacggccacgcgatcgcccttgcgcacgcccacgacctgttgcagataagcggccagcgccgtcgacaggcggtcgacgtcggcataggtgagcgtgcggccgtacgaatggaacgccggacgatcggcgaaacggtgcatcgcgtcgtccagcagcgcgcttacggaaggatggcgatcgggatcgatctcggcggggatcgagccatacgacccggtccagtgtctcttcgtcatgtctcactccacggggacggcgcgccggccgcgcgccgttcgcacgacggcctgcacgccggagaagcgcgggccgtcgcctgaccggcgactatcgcccgtgcgggccgctttgaaaatgatccgggcggccgaaaagatgatcgaaacggacacgcgggcgggcgcgcttgtccagacaacttcgccggccggcgcaggaaaccgcttattccccggcacgaattgcaaagcagcaagcggcatggcacggccgggcgcccttcttcataatcgacgcctgtcattccgctgtcgaaaccatgcagccgctttccctggcccccgccgacaccttctcgtccgtccgcttcctgctgaccgacatggacgagaccctgacccatcacggccgcctgtccgcccgcacctacacggcgctcgaacgcctgcaggcgggcggcatccgcgtgatcccggtgacggccgcgccggcgggctggtgcgaccagatggcgcgcatgtggccggtcgacggcgtgattgccgagaacggcggccttttcatccggcgcggcccggacgggcacggcgtcgaacgccgttactggcatgcggacgatgcgctcgccggcgcgcgcgacgcactccggcgcatcgcgcggcaggtcgaggcggccgtccccgccgcccgccccgccgacgaccaggatttcaggctgacgtcgctcgcgtacgcccgcaccggcggcgaccaggacgaccggatccgcgacgcgctggtcgaggccggcgcggacgcgaccatcaacaacctgtggatcatcgggtgggtcggcgggtacgacaagctgtcgatgtcgctgcgcgtgctgtcggacacgttcggcgtcgatgcgggcgccggcgcggcgcgcgattgtgtcgcctattccggcgactccaccaacgatgcgccgatgttcggctacttcacgcacacggccggcatgagcaccgtggtcgagtatctgcggcagttgcccgcgttgccgcgctggatcacgcagggcccgggcggcagcgggttcgtggagttcgccgacgcgatcctgcgcacgcgcgcggactagggcctgttcacgctaataacgggcttgcgaacgtgcctttccgctcgcagtgcaaggagtaaggagcgccgtttggccgtgccaaacgccccgaaggaagtccccttgggggacaagcgacgcacgacgccgcaatgtgggcggaaaggcacgttccctgtttagaaaaattcgttcgtggggctggccccagaagggccgatcgccgcgtcatgctcctcgcgaatacgtcgagtattcgcttcgtcccacggggacttccgttggtcgtcgcaatccttgcgctcggcccttctgggggccagcgcaagcccgttattagcgtgaacaggccctagcggggctgagcgcgctcgcgcatcgactgtcgcgtgatcctgtcgcgtgatcgtcagggtgaaccctgtggcgcatgggaccgatcccgagcagaattgcgtgccgtaaacgatatcgattcggacgcaggatgttcccatgccgcgcagtgtgcccttgaacccgacgaccgcccgcgcagcccgcctgccggacctcgagccggcccacgcgttgcgccagcagcgcttcacgccggccaagctggccgtgctgctcgacgtggccgcgcaagccggcatcgacccggtcgcggtgctcgacggtaccggcctcacgccggccgccgtcgcggacccgttcacgctcacgtcgccgctgcagttcctcacggccgcgcgcaatgccatcggccgctacgacggcgccgatctcggcgtgcgcgtcggccaccggctgcacgtgtcgagctacgggatgtacggctacgcgatgctgtgctcggaatcgctcgcgcacgcgttcgaatcggccgtcaaatatcaccggctcgcgaacggcatgctcgcgatccgctgggtcgaacagggcgataccgcgtcgtggctgtttcccgaccggcacgaagtcgcgctgcccgatctcgacgagccgctgtaccgtttcctgatcgacatgcagttcgcgctgcacgtgacgatcatcaaggacgtgatgggtgcgtggtgcgtgcccgcgcgtgcgcagttcgcgcagccgcagccggcgcacgcggcgctgctgggcgatgcgctcgaatgcccgatcgcgttcgaccagccgcatcacgtgctcagctatccggccgcgtggctcgcgcgcgcgccgcagctcgcgaatccgattaccgccgcgcaagtgtcgtcgcactgcgcgagcctgctcgacgaattgcgcagccaggccggcgtcacgcggcgcgtgtaccaggaactcacccgcacgcccggacaattccccgatatcgatgcgatcgcggcgatcctgtgcatcacgtcgcgcacgctgcgccgcaagctcgaagccgaaggcacctcgtacagcgaactgctggcgagcgtgcgcaaggcgctcgcgatcgactatctcagcacgaccacgctcagcaccgaggacatcgcatcgacgctcggcttcagcgacgcggtgggtttccgccacgcgttcaagcgctggaccggcatgacgccgagcgacgtgcggcgaaacaagcgcggcggctgagcgcgagcagtgaccgcgctcagcgcccgtcgccggtcgccggcgcggccaccgccagcgcgaactcgaacaccgcccccgcccgggccggtcgaccagccggatactgctgccgttgagcgccagcatccggtgcacgatcagcagcccgagcccgccgctcgtcaccgcgccgccgctcatcggccgctgcggccgctggaacaacccttcgcgccgcgccgccggaatcccttccccagtatcggccacggtcacgagcacgcggtcgccgcgcggctccagcgcgacctcgacctcgccatgcacaggcgtgtgccgcagcgcgttgtcgagcaggttggtcagcacgcgctcgatcatcccgagatcggccgacacgaccggtacccgcgccggaatccgcgcatgcagcgcgacgccgcgcgcctgcgcggtcagctcgaacttctggaacacgtcctgcacgagatcgacgagcgagaacggctcgcgctcggcctgcacaccgcccgattcgaggcgtgcgagctcgaacagcgcctgcgcgagccgcccgaccttcgcgctctgcgcgagtgcgatcgacaggtagcgacgccgttcggtgtcggcgagcgtgtcggccttcagcgacagcgtctccaggtagccgtgcagcgacgtgagcggcgtgcgcaggtcgtgcgagatgttcgtgatcagctcgcgccgctgctggtcctggtgcgtcagcgcgcgccactggtcgccgatccggtcggccatctgcgcaaacgcggattcgagcacgacgatgtcgtcgccgcgccggcccggccgcgagcgcggcaccggcggctgcgtgtcgggcgcgccgttcgcgtcgaagcggcgcatggcgtccgtcagccggcgcagcgggcgcgtgatgaagctgaacgcggtgaggcccgcgagcaggccgagcagcgcgacgagcgccatcgaccacagcgtcgtgcgcagcacgttgccggcgtccacgcgcgcggccagccggtcgtgcgcctcgccgagcagcaccacgtagatgtagcccgacggcggctgccccgcacgctgcagcggcgcggcgctgaagaccttgcgtgcgtcggggctgcgcgggtcgtcgccgaggatcggcagcggctcgcccgcgatgaagcgctgcacgggggcgagatcgacgcggtcgcgcttcacgtggccgggcggcgcatcgtcgcccttgatgcgccccgcgttgtcgagcagatagacctcgacgctcgggttcacgcccatcagctggccgaacagcgtgcgcacggcgtccgggcgcagcccgttcgcgtccatcagcggcgcgctgtgggtcacgctgttgacgatattggcggcgaggtcacgcgacagcccctgcacgacttcctgttcgcgcatgtcgttcgcgcggatctgcagccacgccgatgcgcccgagcacgcgagcagcagcaccgagaacacgagcgacagccgctgggtgagggtgagcttcatcatccgtcccgctggcccggcgcggcgagcttgtagccgcggccccacacggtgaggatccgcacgggctccgccggatcggcctcgatcttcgcgcgcagccggttgatgtgggtgttgaccgtgtgttcgtagccttcgtgctggtaaccccacacggcattgagcaggtccatccgcgagaacaccttgcccgggtgccgcgcgaagaaatacagcaggtcgaattcgcgcggcgtgaggtcgatgcgcgcgccgtccacgctcgcttcgcgcgcgatcgggtcgatcgccagcccggcgacgtcgagcgtacccgcatcgatccgcgaatcgcgcgcgagcgcatcgacgcggcgcagcagcgccttcacacgcgcgacgagttcgagcaccgagaacggcttggccagatagtcgtcggcgccgagctcgaggccgaggatccggtgcacctcgctcgaacgcgcgctcgtgatgatgatcggcgtgtagcgcgtcatcgcccgcgcgcgccggcagatctccaggccgtcgacgcccggcagcatcaggtcgaggatcagcgcatcccagccgccctgctcgagcaggcgcagcccttcggcgccgtccgcgctgtgcacgacctcgtagcgctcgtcgcgcaggtgcaggctgagcacgtcggcgatgtcggcgtcgtcttcgacgatcaggatgcgtttcggttggtccatggcggcggatggcggcacgtcggtgccgaggtcgggtatcggttcgggccggccccgggcccgggccggctggccgggttcccgggagcgaatcgcggcaatgcgccgcgctgccgccattgtgcaaaattttgcgggagggagggatcacatttcgtttatctttgcaccgtgtccgccccgtgagccaatgccggcatggctttccaatccggccccatgaaacgggacctgcgccgttccgtccggacgcaagctggacactcgggctcggatctgtcgagcgatggcggcgcgccccggattgccgatccgaatccgcgctgcacgctgtgtgaatgtgaatggcgcctccgacattcagtgccgccgaccggcacgcgcggcgcacggaacgcgcagcgggaggccgacagcaaacgcctaacccggacggctacgcgtttgacgcgtactcccggttgcgaccgtcgactcattcagcaacaccttcgctgcctcccacgcccgcgcggcggcacgtggatctccgatcgcacgcgcatccgctgtcgccccgctcagcaacatcacatacacgccggccagctgatgtgcgcggcgacgcggaatgatctcggacagcaatcgctccatgatggccaacaggtcgtcccggtagcgcaccgcgacgtcggtcaccttgggacaggtcgcgccgaactcggccagcgcacgctcgaacaggcagcccgcaaattcggggctgcggaaccagacgccgtaccagtcgaagatccccttcaggcgcgcagtggcatccgccatgggttcgagcttggcggcaatgctgtccatgatgaaggtgtagcgctgctccagcaccgccttgatcagatcgtccttgctcgcgaagtgatggtagagcgtcatgcgagccacgtccgcctcggcgatgatccggtcgataccgaccggatgaaagccatggcgggaaaacaactcaccggccttgtccaccacctgctggcgtttgctcgcgcgcatgcatgcttctcctgactacggggcggcatcttagcaccaccgtcagcaccgattcttcaggttgcagggcaagcgttgcaggctgccggtacgaccacgccttgcagggcgtcaaacacgtggccgccatgcccctgctcgcggcagtctcagcaaggcacccggccgccgttcatcatgcaccaccgctgcgtctcctgttgcggggccgcatacggtagtccggttctcggatcgatgtgatcgtactggcccatcgggtgtcgagcccgccacgcggcctgctcggcatactgctgttcgatcgcggcatgctctcgtgccagatccgccttctgcgcatcgtccagtttcttcgtcatggccacgagccgtgcgaacttcggatcgcgaacatcctgcaggggcggaaacggtggcgtaggcggcatgatgagcaccggaccggtgtatttcggtatcgggaaccgggacggccggccgaagttcgccgccatatccatctcccacatcgcagcgcccattccaagcacatgctcgtagtcgcgattgacgaccgccagcgtgaccggccccgacggcgccggcaatggctgcaggacaggcggaagcgtctgtcgagcgtcgggatagatggtacggacatacgtgattgcagcgacggagtactgctggaggaccgcctcgtacgcgtccagtatctgcgctcgaccatagccgccgggattctcgaacatcggcttgtaagccagcaccttctggctatacaacgcattcgcattgcgctgctctgcggcaagccgttgctgaggatccgtcggcgcagacgccgacaggggcgcacaccccgaaaacacgctggcggccagcattagcccgactgtcgcgccaagagccgtccggcgtcgacgcgggatgcgggcgagcgcctggttgaccagggcgaacaaaacgggagttttcctgaatacgcttgtctgcatggcacggcgtccgaaaggcttggtcatcttcggcccggcgccgatcgcgactgcgaacgcgatgcgtcgcagtacagattgaatcggcaccaagccctcattggtgttgaacatcaatccagcgcacatcgcacgacgatgccccgatcgacgagcgacttcagcaaccccgtgtatgtcggacatgcccgggaagcattgagtgcgagcacgtcgtcgatttccgcgctgtcattgcgcacgcatgcgtactgtcgcgcagtggacggttgcagcgaggcaaacgcgccgcacacatgcacgaatgcaacaatctcctcgaacattctcgtattgatgtcgatggcgaccatcatgtcggagccatatccgcattccgaatccaccttcgccgcataggcccgcaggtcgtacgcgggcaaccagggcggatgcaatccgtcgaggctccgggcgatttcatcgataccggctttcagcgtcatggtgaaatcctgcctgcaccggattcggcgtcgcctcctgccgggtaacaggtgcctgtctttacggatcgggaagcaagatatgacgaatgtatactagtcgatctactttgactagaatcccgaatgtcgaagcggaaacagccgatgcatgcgcaacggcctccgctttattgcctttgaatatattttccgatcctgatattcgggaagcggaagcgcttcataaaaacgttacccggcgacgcattccctctcgcgatgccggcaacaggcaaacacaaacgcaccgtacctcgtagcccgcttccacgacctctacggatttctccgccatgccgcgcgcctcctttccgcctcgtttcgccgcatcgttcgcatcgagctgcctgtatggcgccggcctgatgctgggcctcgcgcttgccgtgccggccgccgcacaaacgaccgtatccgcgccacgcgtcgtgtccgagttgaaggacatccgcatgaagccgctcgcgaatctacccatggctggtagcgccaacgatcgcggagactgctcgcaactggtcatccagccgaaatcggcggcggccaggctggtggcagcgcaaggctgggccgtcatgtcggacatgccgctgggaccctaccgcgcgatcagcttcgcgggccagatggaggcagcgaccagcggcacctgcagcatcacgcaaggcaacgtggccgtgttcgagaacggcaggctgatcgcgctggcctatggcaaatcggcggaagataccgccatcggcaggctggccccgctcgagagcggcgccgtgcgcatctgggatggcgacatcgccctcgcccgccggcgacctgcacgtcgaccgcgacggcacgctgcgcctgtccagggtggccgacgcagacgccgtatgccaaggccgcgcgaaggtgcccaacgtctacaacatgccgatcgacaaggcccgcaaggcactgatcgccaacgggtggaatccggtgcgaggcggcgccagcggagagccgcggcagtccgccctggtcaggcgcggcattgtcgagaccgagtcctgcgcgggcaccggctcgcctttgcgacttcggctacacgggccctgccggcaagttgaccttgaccaccgtaggcgaaggcgctctcccgtccgtcacggactacgacgtcaagtgccgctgatctcccatcgtccgccgcgctgcccggccgcgccctccatgaatgcggagcgcctcatgcaacgtctgcacatgcgaacctcggccaacgtcttgcgtgcgctgtccgcttgcgcgctgctggtcggcctgaacgcgtgcgagcgcgcgacgccgtccgtccgcccgatgacagcacctgcgtccgccgcatcccggcctgcccccatgagccggcaatggccgcagatttgccgctgcaggcgctgttgggcgtgttcggcggggtgaagccggcgacctggccagcgttcgacagcgtcaccggcgtgcactgggacgacgccgggccgctcgtcaatccggacgcgaacgcccgcgaggccacgcgctaccgtggcggcagcctgctgcttgcgggttttggcgaggtggacgtgccggacggcaaggtcggcgagagcgccggcgtcaaaaagacaacgaaggccacgtcggcgtcgtactcaacggcaatgcgaccgccgtcctgtcgatcgtgctgcggaagttctacccgaacgacgacacgcaggacattctgctgcgccagttcggcagaggtgccgcggtcaagcgcatcgccggcagctgcgcgcgggactacggcaccaccgcacccaacacgcaaaagaacgtgttctaccgggtcagtatcgccaacgcggccgtaccggtgtttgccgaaacctacgtcgacgaagatggcggcaagcacggccccggtgcaaccaccttcgtgttctaccgcaacaggccggaccaacgtatcacgagcatgcggtgcaagcgcgccgacgcctgagcgagcgcgcctcgacatcgcgccgctcgcacgcgccgtgcatgacgacacctgcccgcggccgcaacggcagccgaaaccgcgaggcgtcgagcgctcgaccgcacacctgaacttctgatcgactggaggacatcgacgtgacgccatcactacacgggaaacgcagcaccatgcgttccgcacgcctgcgcctggccttcgccgggctgatgctgggtctcggctggcaccacgccgcggctgcggccggttgcgaggccaatttcaggcgtgaagccgacaccggcaccggcacgcgcttctcgaccttctccacggtgccgggactggacgcacgcaacgccatcgcgcaactcaagcagattgccgcgagcgacggcttcgtgatcggcgacgaaaattacaccggcccggcgggccagttgaccatccagcaaaagcaaagcgaccgcgcacgcggcttcgccattacgctgacggccaatcaggacacgaaaaccatttccgtggcgacgacgttgccccgggcatgcaggcagcacccgaagccatccggggcggcatgtgcggcatgctcggccgcgtcgacatgagccgcaacgcagtgggctcaggcgtggccgccacggcgcccgcgtcgtccagcgacgcgtttctcggcgcgcccgcctttaccacctgcacctataacttccgccccgcgctggatggcgtcacgggccgccactacaccacctggttgccgatcaaggcgctgaacccggccgacgcggcctcgcggctgacacaagccgccaccgcggcaaagctgagcgtgacgtcgaacgaacgatacggcacgctgaccgacgtcacgatcgtccagccgctcccggaacagggagagaagcgctcgttcccgatccgcttcatgttggaggaggcgctgggcgtgatctccgtggtcgcacgactcaacccgaagcaggagatggacgacgaaacgctgcgcaaggaaatctgcacgctcgtcgcggccatgacggcagcaccaccgggtgaatcgaaagcgccccggcgcttcccgcgagcgcaagctggaaagctggcacaccggcatcgactggctgatcaaccgcgccgtggtggccggcaagtccctcgtgatcgtgcccgcgatcaacctcgacaaaaatacaccggcaacgaggcgatcgacccaaggaaatgggcgttccgtaccgacgtgacggccaccaccatctggcaaaacaagaccgatgcccatgacgtgatacgcgtggggccggacgaacccttcaccgaagtggggctgcacggctacgtatcgaccttcgtggcgggcaacgcccagtacttcgtctacatcgtcaatccgggcacgtacaccgtcgccggcaacacctacgaaacgacctccgaggcgatgtcgcaactcggcacccggcagaagccgggcagctcgccgctggggctgatcgccttgctgcccaagaagaacaccgacttcatccagtcgcaggaatggttcaacgcgcagtatcgtgaccgtgaggtcacgaatacgtactgctcgtcggtcttcgtccagagcggtggctgcgcattctgggcgacggaaaagagcacggtgtcggagatgaccgagcctgcgggatggaagaccgtcacccgcgagaaatccgtcgacgggctggcagtctcgaccaggctcaagcgcgaatttgcttcgttcagcgtagcgccgggcgaagccatcgtgatcgacggcctgtaccctaccccgcccaacgcggactacgacaagcaagcctgcgagatcgccggcggccagatccagtgcgacctgacgcgctacacgctcacgcgcatcgcggccgacatggcgcacgtaaggggctggcttccgacccgggttctacccgcgcgccacgcgcatcctgtccaatgccaggtatcgcccgctcaggctcctgggcaagccgggagaacttcgctcggtgtacggccaggactattcgcttggcgtgcgttagacgcatgccccgaacatcgcgccggacattgccatgaccgccaaaccgcccattgcccgcagcctgttccgcacgtcggggttgtcgtggcggccttgagtttttgcttgccctttgactgcgtatacggacagctcgcggactcggccgcgccggaccgcgcaggcgaatcgcccgtcgaatcccgggcgccggcgaacctgagcacgacgcaggcgctacaacgcatgctggcgctgcttcaggacagcagccaggtgaccgacatcacgcccgaaacggtacaccgcatctttggcgtgcagaccaaagcgatcgacaaggatcagttcggctatggtcaacgcctgccgggcaactgggcattcagtctccaacggctgacgatcggtgataccggtacgcgtgtggatctgatgttcgatccgattcccggcgcgccggcctccccgttgccggcgtgcgagcccgacttcgcccggttcacggaggcactggagtccatggggttcagtcgtcaccctcactatggcgaacacggccggtggctcttcgatgctttcgagcgtcaacgcatgcatgtctcggtctacgccatcggcgcacactccgataacggcgagccaccgggtccggcttgcgtcaaggcggtactggtgcaatagcgcaagccgcctgcctttgcgcaggcactgaattgactcacacggcgagctcgaaaacgatcgcgcaacgacctgaccgttgacgatcagctccacctcgtgccggcccgcataatgccggcgcgtcgtgaaatcgcgcaacggacgactatgctgcagcgtgacacgctgcccgggttcgagcgtcagccccttcagcttgaacaccttcggcgacgcgtcgccattctgcttcacatacgcgatacggtaatcgacgacgagccgctgcgcggtctcggccgtcgattgcagctcgcacgcgagcgtaatcgactcgcctagcaccacctgcgcgggcgtcacgccgaacgggccgatttccagacgcggcgcgctgtcggcacccaggatcgcgagcgctcgcgcattgccctgcttcacgagggtgcggagcgcatgacggacgatccatcgcgtatgcggatggtcgccgccccatcgttcggcccgatcgagcacccacgccggatgcgtcttcgccacgtcgttcaggtgattcgcgaccgagcggcgcacataggcgctcgggtcggagcgaaggttgtcgagaatccgcgcggccagcgacgggtcggcctcgatctcgcggagccggaacgaccagggcagacgcgggcgacttcctcgctcgccagccggcgcacggcatcgtccgcatcgtgcgaccaggcttccatcgttgcgagcgcacgcgccaggtcgatgcgcaggaattcgcgcaccgcgaattccgacgtgccgaacggcgtgaagtatttcagcgcgtccatcgaacggtcgaacgcgtgacgtccgtactgcccgacgtaatcgggcgcgatgagcgatacgaaaccccgacctaatcgcggcgcggcctcctgcaataacgccagcacggcatcgtacccgcccggcagcggccgtgcgcccgtgtcgatcgcgagactggcgcgcctgacgcgctccatcaacgtcaagccgtcgaggccttcgagcaccgtggccagaaatgccgaccggtcgaaggccggctcgatcgaatgcagcgcgtcggacagcgcatggaattgccgcttccccagcgactccttcaacgggacgggaacttgagtggttgtcatgacgtggagatccgacgcgcgccgcggatcatcgggagcgaaagcgcacagtatcgccgaagcccctgccagattctgtcagcagactttacctgtccggcttgcgccgatgcgcgtacagccggcacgggcggatcgcgaaccgcgagcgggcgcacggtattcattcatgcgtcggctcgccgcggctcagcggacggatcgtcgccgaaaagccggttccgcaactgaccgccggcaaaagcaatcgcaatcagcgacaggtaaccggcgacgagcagatgccgccagctgtcgagcgcgacgcgatgcacgaccagcgccgcatcaggcgccggtacggcaagactttccggcacgatcgcacgggtcatctgcacgaagcccgccgccgacagcacgggcagcaggacgagcaaggccagcagcacgaaccttgcgcgacgaaaaacgcacgccggcgcagatgaaaccacaacccgagactaccgtgcacccaccccggtgcaagcagcgcgatctgcagcccctgcgtgccgctcgtgaggagcgacacgatgacccgctcgtagttcggttcgaagccgtagaacgaagttgctacacgggtcccgacaacatggcggatcagcagcatgggcaggctgagtcccgcccagagacgcagccattcggcgggcggcagcgaccagtgccagcggccgtaaatggtgcgaatcgccagcgcgaaatgcaggccggccgcgccgtacagcacgatcgttccgggcaggctttgccagagcccgatcgccaggtgcagcccgcgctcggcgatatcgatggaccagatgccgagcgcgtgattgatcatgtgaatcgaaatatagagccacagcaggatgccggacccgagctgcagcctccgcgcgatcttgcgcatcaggtcatgcaccgacaccggtcgaccgtcgtcggggtcgtgcgtatgcggtgcgtgacgcaaggcacgattgctccgtggcgggcgcatgccgccctcccgcaaccacgacgaccgctgcgctctgcccacgttcggggcgccctcgcgatcgtgctgcgcccggcccggcgtgcccccggtctgcctctccctgtcgtgcattggcgcctcctctccatgcctccagtgcgtgatcgacataccgggaaaccagcccgtttattcccgcgatgagcgacatgccgcggaaatgcatcgcgcagcttcgggaataggtaccgtgctcgccgggtataccgtgtgtgagcgcacgacggaacgacgacagctgcacgtcggcacccaccacgtcagagagagaaacgagccgggtcaaggagaccatcatgtccaacgttctgtcccactggattctgatcggctgcgacgcatacgacgagtacgtgtttgtgccgtggctcgataaatccgtgtatctgcgcacggtcacgctgcgtcgcgtctgtctgctgtgacggcagatgcgcattttcgagcggaattcttcctgcgccatgacgtccgctccgaagccgccaggcactcgctgccgtgctgtacaactctccgtcgacacactgcgccacgcgattggcgaatggcaaaaccgcttgatttcagtgtaatatccgccgcagaagaccatttgtattaccaatccaaataatgaaaacagtccgccggattcaacctggcgactgaaacggggaaagcttgaactcgccattcaataccggaacatccggattcgtcgggccgtacgtgccgtacgtgccgatccacgtcggccggatctcttcttctctatgccgccacttcccgcgcggccgtcccgaattcgactgatatcccgcgccgagcggcccgttccgcgtcgcgtgccttcgtagcacacggccgacacgccgccatcccgcgattcggacatacgtgcgcttgctcgcacggcgccttcacgtcgatcgatcaaaagaagaggattactgaatcatgactgcgtgtacccactgcggcaccgatctgcccgtcgggctcaagttctgcaagcaatgcggaacaccggtggcggccactcgtaacgaagcggccggcgcaccatgccggagctgccatgccgttctgacgccaggccagcgtttctgcaacaagtgcgggacgcccgtcgcatccgcgaatgacaatggcgcaatcgaaatcgacgtgcctgctccaccggccgagcccgcaccgcaacccgcatacgcagccgcggaatcggctcacgcgcctgcgcacgacatcggcgtcgaatcaccggcggcgaacaccgccccgaacgataccccgcacgtcgcgaacatcgccgatgcggaatcggatcgcgcgagcgcaccgctgacatcgcatggcgtcgcagcaaccgccacgcccaacgcagcggcagaccatcgcggcgatacggtcgctgcgtcgtatgtctcgcccgtcgtcaccgacgggcagtccgggcttgcgggcgcatcggcaagcaccgaagcggcgctcgccgccgacgaaacggtcgccgaacctcgcgacgtacccgacaccgataccgcgccggcgccggccgaacccatgcgtccggtatccggcgtgatgccccggccgatcgcacagcccgcgccgacgaacgacgatacgtcggcaagactcaagatcattgcggcgggcgtcgcggtcgccgtcgcctgcgcgggcggcgcattctggtggcacggccgccaggcgagcgccccgcaatgcccgagccggtcgccgcatccacggtgccggccgtcccggccaacgccgcgtcggacatcaccggagcaggtaccgtcatcgccagcgcggtcgttgcgacgacgccggccgacacaccggcgtccgcgccgatcgatacggccaccgccgccgcagccgcgacctcgcccgcgtcgggcccggccgtcgtcacgaatgtcgcgacggcttcggtgcccgcgacgccgcccgcgtcgaacacgccgcctgcatcggcgaacgcgcagcagacgtcgccgttcgcgaaactgcaggacgacgcacccgcaccacccgcacccgccgccgttgcggaagcatcgcgcaacaaaccgcgcccagcaccgcccgtgcgcccgtccacggcggccaaccccgcatcacccgccgtcgacggcctgctgaaacgcgcgcagggcgacctgtcgcgcggccagtacgacaaggccatcgcgacagcggaaagcgtccttgcgatcgagcccggcaaccgtccggcgaagacgctcatcggcaaggcgaaggcgcggcagatggatgcactgcgcaacaacagcacacttgaatgaagcgccggagaacaccgacatgacaatccagaaaaccctcgccgcggcctgcgcggtcaccttgctcgccagcggctgcgccacccagaacggcgccggcgggatctcgtccgaatccgtgctgcgctgtacggcgctcggcgccggcggcgcactggtcggcgcgctgatcggcggcaccaagggcgcgatcggcggcgcggtggccgggctcgccgcgtgcgccgtgatcgaagtggcgacacggcagacgaagacggcagccgaagtcgatcgcgattaccgcgcgagcaaccgcaacaacctgccgccctacgcgaagatcgacgcgtacaacacggtcgtgacgccgcgctccgccgtcaaggccggcgagccgatcaggctggcctcgcagattcgcgcggtgtccggcacgaacgagcccgtccaggaggtcaaggaagtcgtgaccgtctatgcaccgtcgggcgaacagttcaagcgcggcgagaaggtcgtcaacgcgacgccgggcagcggcgaattcgacaacagcttcacgctgaaactgccgtcgggtgcaccgcaaggcacgtatacgctgaaaagccaggtctacctgaacggcaagccgggctcggtccggcagtcgagcatccagctcgcgcaggtcgacggcgtcaccgtcgtcgcgctgctcgacgcccccgccgcacactgacccgcccgcacctgcaaggagattcaacgatgtcaacgctcgatcacgcccccgtgtcgggaagttcggactactgcgcgccgccgaggccgtcacgaactggcgcgcactcgcgatgtgcgctttcgcgctcgtcgccagcatgctgatgggcatgctcacgatccaggtactcggtcacagtcccgtgctcggcctgctgttcgtcatcgcgacctgcgcgatctcgctgatcggttattccgcggtcggcatcgtgctgatgcgcgatgcccagggcgagccggtcggattcgtcgacgcgctgctgcaagcgacgttcaccgtccaccgcctgatcggggtcggcgtgctgctcgccgtcggctgggtgctgttcctgctcgcgctgctgatcgtgttcctggtctgcaagatcccgggcctcggcccgctgctctatgcgatcgcgtatccgctcgcggcgatcgtcgcgggcgcgatcttcgccggcatgtggtacgtcggctatccgctggccgcgcccgccatctggcagggcaactcgacgctgcagaccgccgcgcgcctgctgcagatcggccgccgccagctgctcggcgtgatcgtcaggatgttcgggctgctgctgctcgtcggcgtcctgtccgcggtcgtactcggcattctcggcacgggcgccgcgatcgcctcgtcgatctcggcggccaccggcaccagcccgctgggcggcctgatgagcacgctcggcggcctgggcggcttcggccgccatgccggcgcgtacggcctcggcacggatgcggcggaaggcggattcgactaccgcagcatggcctatctgggcgcgtacggcttcggcaacggcctgctgatcgcgatcggcctcgtgatcccgttcctgacgttcgtcaacggcacgtgcctcatctatctgcagacggtcagcggcgtcgatttctccgcgaccgaagagaaactgagccagcacgtcgcggacgcgaaacgccacgccgaacaggcacgcgagcgcgccgccgatcacctcgcgaaagcacgcgcgtcacacgccgccggcgcggccggcacggcttcgctgccggcgtcggatacggcctcgcccgccacggacgaagccacggcgtgtgcgcagtgtcacaagccgatggccgccgacgacctgttctgcggcgaatgcggcgcacgccgtcacgcgtgacggctgcatgatcgcgccggcgcctgctgtcgatcggcaggcgccggccggttcagccgcgcgagcctccccggctcgtccacgccgtcaccacgcggcaaacacgtcctgcgcgatcccgaagcccgtgctcatcccggcgccgctcgtcacgacgacgacacgcgtgccgtcgtccggcgcttcgatcacgcaatcggcatcgggcgccgacggatagctgccggtccagcgttcgaccacatccagctccgtcacatcgagcgtctcgtgcagcaggcgcaggatctgcgcatcgatctcctgcgttgcgaacggcagcggcgcggcgccgtattcatgcgaatcgcccaccacgagactgccgtcggcgctctgcaccgcgatcaggtggatgccgtacccgacgcacacgggctcctccgcgttcaggcgcgcacgcaacgcgccggcggccggcagcgccgcgaaccccgcgtaacgcagcagactcaggtcgctcatcaccgcggcgcgcagcgccagcgggcggcgcggccgcacgcgcagcatctgtaactggcacaggcggacctcgtgccgagcgaaccagtcgccgtacaggtgacggctgtccgcattgccgcagacgatcacgcgctccgcgtgcagcacgccgcgcgacgtccggaccgtcggcgtgcgcacctcgtgcaccagctcgccgtagcggaaccgcacgccgaagcgttcggccagccatgacgccagcaacccgatcgcggtacgcggctcgatgcgcagttcatgcgggctgtgcaggacgccctgcgcgccgtccagccgcagctcgggcgccacggccgccgcttcgccgggcgtcatgatccggcaaccgtcggccatgccggtctgcatgaacgcatcgatcaggtgcatcgcctcggggcgacgcgcaatcaggtgcaggccctggtgaagcacgtcgatgccggcttgcggcgccacgtccgcccagacctcgcggctcgcccgcgcccgccgccagctgtgcccggcgtgctgcccggtgaccgtgacgaaaccgaaattgcggatcgacgcgcccacgcatgcggcatcgcgttcgatcacgcagacgcgcagcccctcgagcgccgccgtataggcatgggcgaggccgacgatgcccgcgccgacgacgatcacgtcgtaagcatccgccgctgcgatggcgttcacgatggcacgctccttctgtcgagatgtgatgcaccgcccgttcggagcgggcgtgtcggttgcagtgcgccgcgttcctcgggtagatctccgtgactggcgcgcgatcccgcactatcgcgacgcgagatgacatccgcgtgaaaaaccacaaaacggcatgttttggcaaaatttgccattgcacgacgccgtggagaatcgcatcgatccgttggtgcgcggcattcgcacatgccgtagccggcgcgtggcgcaacgtgaccggcgcggcaggacagcgcgatgccgaggtcagtacagcagaaatgccgcacgttcgcgcgcgaacgcaacactccgcgtctcgaccacccgttcgatatcgccgagcggccgccccgcatccagcatgtccgccacttcgcgcgagccgatcgacgcgcggattgcatcgatccggaattgcaccggatatcgccgatgcaacgccagcgcgagcgccagcccgatttcacccggccgcgtcgcgccgggccgccgttggatgcgcacgccttcgcacaacctgccgcgatacggccctccgtcggtacgaaccggaccggcgtgaacgtcgcagccagccccgtcgcgcgaagatcgccggcgagcacgcgcccgtcgatccacggcgcgccgaccacgccgaacggcgtcgcggttccgcgccccacgctgagtgccgcccctcgatgagccccgtctccggatagagcgacacggcggcgccatcccgcaaattcggcgacggcggcacccagccgagcccggtgtcgtcgaaacgcatcgcgcgtgcgtagttcgccatcggcaccacggtgagcgccgcgccgatatgcaggcgcgcattgaagagccgcgcgagctcgccgagcgtcatgccgggctgcagcggcaacggggaataaccggtgaacgtcgccggctccgcatcggccacggggccgccgaccacgtcggcgcccagcgggtcggggcggtcgagcacgagcaccgggcggtgcgcggcagccgctgcctccagcgcgtagccgagcgtggccagatacgtgaagaagcgcacgcctgcatcctgcaggtcgatcaccagcacgtcgacgtcggcgagccactcgggcgcgatcctgcgccggtccccgtagaggctgtgaacggtcacgccggtcgcggcgtcggtcgtgtcgccgaacgtttcgtcgacatccgtgccgagcccgtgctcgggcgcgaacagcgcgacgagccgcgcgccaggcacccgcgcgagcaggtcggccgaacgccggccgaaccggtcgaatccgctcctgttggtcaggaatgcgattcgcttgccggccacggcggcaaagccgcttgccgcgagcacgtcgatgccggccagcaccggcccgcgcgaaaccggcaaccggccggcctgcgcgacggccgcagccatcgtcggcacgcgtgtcgcgatctgcaatgacgtcaccggcgcggccgcgctcgatacgaggccgaccacgagcgcgcgcagcggcatcgcggtgccggtttcgtcgggatacagccggctcgtcagcacgatcgcgaaacggcgcgtcacgggatcgatccacagcgccgtgcccgtatagccgagatgctccagcgcaccggccggcggcagccggtagcggttcgccacgagcggcggcccgacccgccagccgggcgtatgccagtcgccttcggcgtcgagcgtggccggcgtctcgagcgcggcgacactgccgtcgccgagcacgcgtgtctcgccgagcgtgccgccgttcaggagcatgcgcgcgaagcgcgccagatcgccggcactcgagaacaaccccgcattgcccgcgacaccgcccatcgccgccgcgacgggatcgtgcacgcgcccctgagcaactgcccgtcgcgaacgagcgtcggcgcgacgcgtgcccgtatcgccgtgcccggcctgaaggtggtatcggccatgccgagcggcgcgaacacgtgacccgcacaccatgtgtcgagcggctgccccgacacgcgcgcgacgatctcgccgagcgccacgtagttgacgtcgctgtagcgcacacgggtgccgggaggctccgcgggcgtcatcgcgacgatgtcggccagcacggccgcacggctgcgcaatgcgcgcgacgacgacacgccggccggcaggcccgacacgtgcgcgagcagctggcggatcgtgatcgtgtccttgccgtgcgccgcgaatgcgggccagtagcgcgcggccggtgcgtcgaggcccagcaggccgcgctccgcgagctggaagatcgcgaccgccgtcgccacgggcttggtcagcgacgcgagatcgaagacggtatcggccgtcatcgcctccgcgtgctcacccgtcacccgcaagccgcgcgccacgcgcacctgcacgccgtccgcgtcgccggtcacgacgaccgcgccggcaagatggccgtcggcgatttcagccgcgatcgccgcatcgatcgcggccgcctggcgttgcgccgccgtcgccgtcgccggtgccgcgtcgcgcaccgcgcgagcgccggccggcgccagcgcgaacagcagcgcaccggtcagcgcggcagcgcagcgggatcgtaacgattgcgcggattccacagcatccatccatccgtgccggccgcgtccgcggcgtcgacctgcgcgcggatgtccgccgcgtcgaacgcgcgccggtcgaacgcatagtcgcgaaatgcctgcagccacggccggaaccgcacgccgtcgagccccgtgcggcgcatcgcttccgcgagcgaccgcccgacgatctcgccggggtgatcggtcggcttgcggcagcccggcagccccacgtgaagcccgacggatacagcatcggcgaaatgtaatcgaccagcccgcccagtgagccgagccgctgcccgatctgcgtgtcgtcggcattccagcacacgtagccgaagatatcggccgacaggtagcggttgtaaggccgcaaccgtgcgcgcgcgccctccaggaatccggtgatcgcggccacgcggttcgcctcggtgttgggttcgtggaaccgcaggccgctcgcatccggaaagcgcagatagtcgaactggatctcgtcgaaacccatccgcgcggcctcctcggccacatcgaagttgtgttcccacgcggcgcgcacggtcggatcgatccagcgcagatgctcgcgatcacgccagattccgccggccgcgtcgcgcaccgcccagtcgggatgggcggccgcgagcggatcgtccttgaatacgacgatgcgcgcgatcaggtagagcccgcgcaggtggaatgcgcggatcagcgccggcaggtccgcgacgcgcgggcccggctcgccgctcgccgcgccgatcgcttcgcgtgcgtcgctgcgatacggcgtcatcccgcgatcgcccttcacgtcgatcacgaacgcgttgacggccgtgcggcccgggagcgcgagcgccgcgtcgcgcagcgtgcgatccgcgacaccgtagaccgacaggtagacggccttcggacggaacgggacgagccgcaccgtgcgtgccgtctcgccggcggcgagcacgacctccgcgcgtgcatagccgggcgcggtcacgctgagcgtcacgtcgcccgccggcgcggcaaacatgccggcagccgatgcaaccaggctgctgcccgacgcataaccgagcgcacccgacaccggccggccgctgccggcatcgacgaccgtcaccgggacggttccggcccgggcggcgacacacgcgagcgccagcagcatgcccgccagcacgcggccgagcgtcgctgcgccctgccacccgcctcgaaacggctcatgccggtgccgcccggcacgcggccaatggacgattgcccgattcttcaaagcacacctcgcgacgcgaattcctgcggatattgttgcgaatccgccgccacgccgcgtgaggcagatcaacggcacgcgctgcgccgctgcccgaaacgcgtcgatcgcactgcgcgtctagggcgtgcctgcgcccggacaaccgctgcaaagccgcatcacatcgcgccggtccgggttccgccagtagaaccgcatatcgacggcgccgtgcgccggcacgacgacgtgacggacttcctgaacggcccgatcgcgcgccgataccgtatatcgccccggcggcacgcgcgcgaacaggaacgggccggccgtgtgcgcgtcgaggatcgtcgacttgccggacgccaacgtgacgtcgatgtcggacaggtaatgaccggccttcgtcgcgaacgtgatccgcaggttgtaacgcggcgcagcggcgcgaaacgccgcgacttcctcctcgccgacgccgcccgtgatgtatacagcgccgttccgcacgaccggctcgggcagcgcttgagccggcacgctcgcggcggcggccatcaaacaggtcgacagcagtagcgacccgacgattccagtccgcattttcgttctcccgattcaggcacgcgggtggcgatgcggctcgttcgttcgggcgcgtcacggccggcgtgccgcgacgtgacgcattcgcatcgttgacgaagccagcgtcgcgcggaacgtcgatttccggttgacgcaggtcaagtgcccccgaccggcccgcggcgcggcgagccggcccgcggctcacgatcgggcggcgcggccggcccgcacgacgcgccacgcgcggcggcgcggcgccattgtccgttccggctgtcagccgatattgcgcggcgcgtcggaaatttccgacacggcgacccgacgtcggacagcaagctcaggccgcgctgattgtccggccatgttccgccgccaatactggagacgtgacaggatgcaacgcgtaccgcggctcgcgagcaagtgttccgcacggccgccaccagttccaggagctggccatgaatcacccgaacacagcccatgccgacgatgccgcgccgcaccacgaccttccggtcggcgcccacctcgtgacccggcgccccggttacgttcaccacgggatctacatcggcaacggcaacgtgatccactacgcgggcctggcacgcagtccaggcggcggcccggtcgaagtcgtctccctcgacgacttctgcgccggtttcggtctcgcgatggtccggcacgcgcgggctccgtacgacggcacggaggcggcgcggcgcgcaacctcgcgcctcggcgaatgccgctaccggctgctcaccaacaactgcgagcacttctgcctgtggtgcctgttcggcgtcggcaggagcgagcaggtcgcgtcgtgcctgcgcaacccgcttcacggcattgcggtcgtcgccatgctgcttgcgtgcgtgctggccgggcggctgcatgcggcgtccgtcgaacgcacgccggccccgcgtgcctgcccggctcgatgcggggcctagcgcgacctgaatcgacctgacgcccccgcccctcacccgcatgggcgaaaggcagcatgcgcccgcccccagcgtttcgcctgcgcgatcgcgatacggatcgcgctgccctcggcgcgcccttgccgcagcagcgcgttggcgatctcgatcgccttgccgcgaaccggcggcggcaggttccgcatcgacggcggatagcgttcgtcattccacggcatggtcgatccggctcgtacgggctggccgatcccgcagtgccggccggcgggaatcgcggcaggaacgcagcgatggtgcagcgggctccacgggatccggcccggcgtgagccccgacggagacgacatcggcgaacgaccgcggtaaccccgcgatccggtgaccggtcacggctgctccccggcggtttgcagcaatccgttcatgcatcgcgtgccgcacgcatccgtcatcagatagcgcggcaatgccatcggggatccgtcggccgaacggggcgggcatcgatcgtgaacgccgcgacatagccttcgcgagcggccagccggtcggtctgcgcatcatggacgccgaacggccaggccagcagccggatcggccgaccggtttcggattcgagccgctcgcgcgaccggtccaactggaacgagacgaatcgttggtaatccgcttcagtgcgccgcgcgcgctcggtggcgaaattcggatgccagtaggtatgcgactcgatatcgtatccgccggatcggccgagcgcgcgcaactgatcccacgtcatcgcgtagcgggcgttggaaatcgccgacggatagatgaacagcgtgaccggcaccggatgcgccgccagcagcgggcgcagcacgtcgtagacggaacggtgaccgtcgtccaccgtgatcgcgaccgcgcgcgccggtagcgcatccgtctggccatcgtgccagcgcacgacgtcggcgagcggcacgatacggtagccgctcgcctcgatcgcatgcagttgctcgacgaatgtcccggtgcgcaccgtcatcgaatccacgcgttgcgtcgcaaaccggtgatagacgagtatcagcacgcgttgcgacacgggcgcgaccgtgccggcgccggcggacgacatccgcggcagacacgacagcagcagcaggcagacgatcgcgcgcaagctcatgccgcgcctcgcgccatggccgtgccgcgtgcctgcgcaaccagttccgcatgaatccgctcgacgtcctcgcgtgtacacagtgccgtaccgggatgctcgaccgacgcggccgatgccgccagcgcataccggcacgcgtcgtcgaacggcacgccgcgcgccagcgcccagatcatcccgccgacgaaactgtcgccggcacccaccgtgctgcacacggccgcgggcctgcccggcaggcgcagcgcgcgctcgcgcgtgacaacccatgcgccgcgcgcgccgagtgtcagcgcaacgatgtcggcgcgcccctgcgcgacgagctcgcccgccttccggcatgccgacgcttcgtcgagcggttcaccggccagcgcgctcagttcgtcgaggctgggcttcacgagatggacaccggcgtcgagggcggcgcgcagcgccgggcccgccgcgtcgacgaccacccggctgccgttcgcggcggccgtccgcgcgagcgtcgcatacaggtcgtccggcgcgccgggcggcaggctgccgctcagcacgagatagcgcggcgcgggttgcaaggccgcgatgcgggccgcgcagtcgcgccactcggcggccgtgaccaacggccccggcatcaggaaacggtattcacgccccgtcgcggtctcggtcacgcacacgttctcgcgcgtctcgccggcaatccgcaggcggacggacggcacgtgttcggcttcgagcagcagcgtcagcacgtcgcccgtcggcccgcccgccaggtacagcgcaacgcagtcgccgccgagccggtgaacggtccgggcgacgttgatcccgccgccgcccgggtcccgcctgggtcgcgcgcagcgcagcttgtgcgtatcgacgatatgttcgaccgacgtcgagacatcgacggccggattcaacgtgacggtaacgatctcggtcatggcgcgtggtcggtggaagacacgattcgcgggcttgcgcggcacccgcccgcggccgtgccgcgttccggccatcgacgcaggccggccctgtcaccaccttacgcatgccccttcgcaccgcgttgacgaccgtcaaacgatgccgcaaccgcgccggattgcgctcgatcaacgacgcgggcgagcaggcccttacagtgaatcatccgtcgtcgccgagccccgccatggacgagcagccgctttgcaccaccgtgctcgccgagcgctatgcgcagcccggcgaaacgtcgcgcgcggccgtcttccagcgtgtcgcccgtgcactgtcactcgccgagccgcccgcgctgcgcgcccgggccgagcgcacgttcttcctgaacctgcagcgcggcgcgatcggcgccggccgcatcatggcgaatgccggctcgacggcaggcggaacgatgatcaactgcttcgtccacccgctggcggttcccgtggagacgccgctgcaaggcaccgacgcggcgctcgcgcaggcgctcgacgacgcccggctcacgctgctgatgggcggcgggatcggctacgacttctcgccggtgccgcccgccggcgcgtacgaacgccgcctgtcgtccgaacgtggcgcctgcgcggcgatcgaccgcttcgatgcgatgtgccgcacgctgccgttcaccggcccgcgccgcggcgcgcagatgggcgtgctgcgctgcgatcatccggatctggccgcgttcgtcacggccaagcgcgggcgatcgcgctggccgaccttcaacctgtcggtcggcatcacggacgcgttcatggaagcggtcgcgcacgatctgccatgggcgctcgtccatcacgcgccgcgccacgcagccgacgttgcgtcgccccggcggcaagacgggcgctaccttcatgcgacggttcctgctcgcaagctgtggcaaacgatcgtcaacgccgcacgcgacagcgccgaacccgggctgctgttcctcgacacgatccgcgacgcgaaccgctgcgcgagcacgagcggatcgacgcgacgaacccgtgcggcgaacagccgctgccgccctacggcagctgcgtgctcgggccgatcgacctgtcgcggttcgtgcttcatccgttcggcatcggcggcgagccgcaattcgatttcgcggcgcttgccgacgcggtgcacgtccaggtgcgcctgctcgacgatgtgctcgacctcaccgcatggccgctcgccgctcatgcacgtgaagcgcagcggacacggcgcatcggtgtcggcgtgacgggcctgggcgacgcgctgacgatgctgcggctacgctacgacagcgtcgaggcgcgcgcatgtgcgcgcagcatcgcgctgacgatgcgcgagcacgcgtttgccgcatcggccgcgctggccgccgagcgcggcgcgtttcccgcctacgatccggccgcttacctgaccggccccgcctaccgcatgcggctgccgctgaaggtgcatcacgcgatcgaccggcacgggctgcgcaacagccatctgctgtcgttcgcgccggccggcagcgtgagtctcgcgttctgcgacaactgctcgaacggcatcgagccggccgtcggctggacgcagcgccggatggtccgcacggcagacgggcaggtgcgcgcgttccgggtgcagaaccatgcttaccggctgtttcgcgcgctgcatggcgaccgcgtcgagctgccggactatttcgctaccgcggccgagatcgcaccgctcgatcacgtcgcgatgctcgcggcgctccagccctgcgtcgacgccggcatctcgaagaccgtgacgctggacagccaatgttcgctggcgcaggtcgacgcgctgttcttcgcggcgtggcgcgaccggctcaagggcatcacggtgttccgccccgacccgcggctcgcgtcggtcgtcaccgacgacaccgcgcaactgcgcgacggcgcggtctgcatcggctgttgagcggcccgatcgccggtcgcgggtcaggccgacgtgtccgtggccgctaccggctccgcatcggctcgcgccggctcgggcgccgcgccgcgatcgtccggcggcgtaatgagcgccaccagcgtgtcgtgatcgatcgactcgtgctgcagcaggcaccgcgcgatccgttcgagcgcgtcgcgatgctcggcgagcgtcgccgcgacgcggaggtgcgcgtcttcgagcagcgcgcgcacctcctcgtcgatcaactgcgcggtgtgttcgctgcaccggccgtcgcccggcgtccacacgccgggtgaaccgccttgcggcgtcgcgtcgtccagcgtcgccaggccgagcttcgcgctcatcccgtactgcatgaccatgtgccgcgccagcgcggtcgctcgctcgaggtcgttctgcgcgcccgtcgacacgtcgccgaacacgagttcctcggcgacgcgcccgccgagcaggacgtcgagccgctcgagcagctcgctcttgcgcagcacgtagcgatcctcggtcggcacctgctgcgtgtagccgagcgccgcgatgccgcgcggaatgatcgacaccttcttcaccggatcgcaatgcacgcggctttgcgcgatgagcgcgtgccccgcctcgtggtacgcgatggtccgcttttcctcgtcgttcatcacgcggctcctgcgctccatgcccgtcatcgcgcgatcgatcgcctcgtcgaagtcggccatgccgatcgccggcttgccgagttcggccgcatgcagcgcggcctcgttgacgacgttcgcgagatccgcgccgacgaagcccggcgtgcgctgcgccagctcggcaaggtcgacctccggggccagcttcacgcgcttcgtgtgcacggcaaggatctgcttgcggccggtcaggtcgggccggtcgatcgcgatgtggcggtcgaagcgcccgggccgcagcaacgccggatccaggatctccggccggttggtcgcggccatgatgatcacgcccgaattggcctggaagccgtccatctcgacgagcagctggttgagcgtctgctcgcgctcgtcgttgccggacatcaggccgacgccgcgcgccttgccgagcgcatcgagctcgtcgatgaacacgatgcacggcgccttctgctgggcctgctcgaacaggtcgcgcacgcgtgccgcgccgaccccgacgaacatctcgacgaacgccgagccgctgatcgtgaagaacggcaccgccgcctcgccggccaccgcgcgcgcgagcagcgtcttgccggtgccgggcgcgccgacgatcagcacgcccttcgggatcttgccgccgagccgctggtagcgttcggggttgcgcaggaacgcgacgatctgctgcagttcggccttcgcctcgtcgatgccggcgatgtcgtcgaacgtgatgccggtttcctgctgcacgtacacgcgtgcctggcttttgcccatgccgctgaagtcccggaccccgcccggcctgcgcatcatgaagctccagaacgtcatgaggacgatcaccggcaatatccacccggcaagcgtttccagccagcccgaatccgacacgccgcgatagcggatgccggcggccgtgagttcggtgacgaggcgatcgtcagcgacccggttggtcgtgaagcgccacggcggcccggccttcttcacggcggccgcgtcggaggccggcaggttcgcagcggcctcgggcatgcgcagcacgcccgaaatcgacgactggccgatgtccagatcgtcgacgagccgcgcgtcgaccaggcggtgaaagtcgctgtacgggatcgacgttgttgccggccgggtcatcagcagctgatacgccaccagcgcggcaaacacgaacgggatcagcagtccggagtaatcgaatgatttttcatcgcatcaggcccgctcgccggacacccctccgttcatgcgtcgttgcgcgtccattgcgcgcgcaggatgtcctcgccgtcgcgatagtggatcgcgagatcgccgtgatgcgcatgcagcaacgcttccccagccgtcgcaccatgtgcacgcccgtcgtgcggacgacgagcgtatcggcggatttctcgatttccatgatgcgttcgagcgcgtgctcgctcgtctccagaatggcctggcgctcgagcaggtcgagaatcgtcgcccggtgcgcgcacaggtacgcgccgtgcagcaccagttcgcccgccggcaggttttcccgcatgcgcttgcaggccgggcattcgagctggcgccggtcgagcggcgtcgcgtaccacgtccagcggcccgcgtcgcagacggcgccgcagccttcgcagatcctgtcgcccttcggccgcttcggatcgcggtaactgtccttcgtatgcggctgcatgcgcctgtcgtggcgcagagggtgtcggccggggccggaattcgaacggttcatgactgcgtctcctcgcagtggacggcactggcgagccgtcagccgacggtgagccggtcgacgacctcccggacgcctctcaccgacccggccgcaccgcacgcggcccgcctttcggcgagcgacgcgaccttgcccgtcaacgtgacgacgccgtcggccgcgtcgatcgcaattcccgcggattcgcgccgcgcgcgacgcgcaagcgcttcggcgatccgcgtgccgacgtccggcaccgtgtgatccgtgcgcacccggatccggttcgcgacgccgacgacgccgatcatccggctgaccatcttttccgccgcccggctctggtatgcatgatcgacttcaccgtcgagcgtcacgcaaccgtgatcgacctcgacgcgaatcttgtgatcgcgcagcgcctcctgccagccgagcgcgaacgtgatcgcgatcgccagttcctggtccgcgcacgcgttctcctgcggtgcaacgttcagttcgagcacgagcgcgcgcgcatcctcgacatgcagcgccgttttctgcgcctcgagtttctgggcccagctgtcgaccgtgccgcgcaacgtcacgatccggtcgtgtacgtcgacgtcgatccgccgtgcatcgaccgccggattccagaacagcgcctgctcgacatcctgcttgagtgctgcatcggacttcattgccgtctcctgtcggcccgtgccggtcgcgacattcgcgatcggcgatggggccgcaccggattcagcatcgcgcaaggcggcgccggcggtttgacgaggatcaatcaacgccgtgcttgcggcagccgccgtcgcgcacactcgatcccgatttttccgttgacgcagatcaactgcgcgacggggtgcgacgcgatcatgtccccggccgccgcgacattcgtggcggcccgcacgcttcgtatcgttgcgacagccgctcccgggagaccgtcatgaaccgcaggcaataccgcatctcgctggcaacgctcagcgtattcatcgcgctcgcatcgctggccggcatcattcacggcatgctgttcgacgagcgggttttcagatactcgatcgtcacgctgatcctgagcatcctctcgttcgccgtcctgctgaacctcgcccctggcgatcggccgtgacgcgtgcgaccgcgtcgggccggcgcaacccgccggcccggggccatgttccggcgcgcctgtcaaccgaagcaccgctcgaaacgcattcccgccgaagtgattcagatcaagggtaggagcgtcaatcgtcggatataagtgaacccgaagcggcgacgccacgaggcggcgccaccccgcgtttccgtattcgccgaggctttccatgcgcgccaccgcgcttcccgtcgtgttccgcactgcagcttcccggtacgggcgtttcgttgcgctcgcaacgggtatcggcctgctgtccggatgcctgtcgctcgccccgccggaccagcgtcccgccgcgccgatccccgccgcctttccggatccgtcggccggcgccacgcccgcggccgcgccggtgcccgcatggcaggactacttcgtcgatgcgcgcctgcgggcgctgatcgcgcaggcgctggccaacaatcgcgacctgcgcgcggccgtcgcgcgcgtcgaacaggcccgtgccgtctacggcatccgcagcgcggaccagtggccgacgatcggcgccggcgcggcctatgcgcggtttcgtgcaccgggcgggctcctcacgccgacgccgttcatcggccaggcctacgaggtgcggctggccgagacgcaatgggagctcgatttctggggccgcgtgcgcaacctgaaggacgcagcgctgcagcgctatctcgcgagcgatgcggcccggcgtgccgcgacgctgagcgtgatcacgtcggtcgccaacgcgtacctgacgctgtgcgagtacgacgagcgtatcgcgctgacccgcgcgacgatcgacacgcgccgcgagtcgctgcggattttccggcttcgccatgcggccggcgcgatctcgcgcctcgacctgacgcaggccgagatcctgctgcagcaagcggaatccctcggcgcccagttgcaacaggcgcgcgcatcggcggccgatgcactggccctgctggtcggtgcgccgccggatctggccggcgcgccgctcgcgctcgacgacgccgccgtcgcgccgtcgctcgcccccggcctgccctcgtcgctgctcgcgcagcggccggacgtgatcgcggccgaacacgaactgcaggcgtcccgcgccaacatcggcgcggcgcgcgccgcgttctttccgcgcatcgcgctgacgagctcgatcggctcgggcagcagcgcactgcatgagttgctgacgtccggcaccggcgtctggtcggtgatcccgaacgtgacgctgccgctgatcgacggcggccgcaaccgctcgaatctcgcgctcgcgcacgcgcagcacgacgaagcgctcgcgcgatacgagcggacgatccagagcgcgtttcgcgacgtgtccgatgcgcttgcgtcccgctactggctggccgacgaggtgcgtatcgagcgcgccacgctggattcgcaggccgaacgggcccgcctcgcgaagctgcgctacgacagcggcgcgacccgcttcctcgaggtgctcgacgcgcagcgggacctgatgaacgcggagcagcaatgggtgatgacgcgtcgcgcgctgttgtcgagccgcgtcgcgctgtacggcgcgctcggcggcgccacgcacgacggcgacgccgccgccgcgcgaccgaccaacgaatcgacgaatccggattccacacgatgaaaaccctcaagcgccctcttctgatcggggcaggcgtcgccgtgctcgcgatcggcatcacgtatttcggatggacgcgctggcgtgacgggcaggccgatgccggcctcgcgagcggcaacggccgcatcgaggcgaccgagatcgacgtcgcgaccaagctgccggggcgcgtcaccgcgatgctcgtcgacgaaggcgacttcgtgaaggccgggcagccgctcgcgcgcatggacgtggtcgtcctgcaggcacagctcgacgaggcgcgcgcccgggaggcgcaggccgtgaacacggcggcgagcatcgacgcgcaggtcgcgcagcggcgcagcgacaaggcggcggccgaggccgtcgtcgtccagcgggaaagcgaactggatgcggcgacgcggcggctcgcgcgctccgaaacgctgtcgcgcgacggtgcgtcgtcgatgcaggaactcgacgacgatcgcgcgcgcgccggcagcctgcgggcgaccgtgaatgccgcgcgcgcgcaggtgcaggctgcccaggccgcgatcgacgcgacccgggcccagctggtcgccgcgcactcggcggtgacggccgcgcaggcgaccgtcgcgcgcgtgcaggccgacatctcggacagcgacctgacctcaccgcgcgacgggcgcgtgcagtatcgcgtggccgaatcgggcgaggtgctgccggccggcggcaaggtgctcaacgtggtcgacctgtcggacgtctacatgacgttcttcctgcccgagacggtcgtcggccgggtgccgctcggcgccgacgtgcggatcgtgctcgacgcggcgccggaatacgtgattccggcccgcgtgtcgtacgtgtcgagcaccgcgcagttcacgccgaagacggtcgagacggccaccgagcggcagaagctgatgttccgggtgaaggcgcgcatcgaccgcgacctgctgcagcgccacctgaagctcgtcaagaccgggctgccgggtgtcgcatggctgaaggtcgatccgaacgccgcgtggcccgcgcgcctcgcgatcaaggtgccgcaatgaaatcggcgctcccggccgatacgggtgccggcgcgaccgaagcgccgccggcacccgcgccggtcgcacggctgtccggcgtctcgctgcgctacggcgacaaggccgcgctcgacgacgtgacgctcgacatcccggccggccgcatggtcgggctgatcggcccggacggggtcggcaagtcgagcctgctcgcgctcgtgtccggcgcacgcgcgatccagcaggggcgcgtctgggccctcggcggcgacctggcgtcgcgccgtcatcgcgcgcgcgtgtgccggcgcatcgcgtacatgccgcagggcctgggccggaacctctacgcgacgctgtccgtcgaggaaaacctgcagttcttcgcgcggctgttcggccacgatgcggcggagcggcgccgccggatcgacgcgctcacgcgcagcaccggccttcacccgttcctggatcgccccgccggcaagctgtccggcggcatgaagcagaagctcggcttgtgctgcgcgctgatccacgatcctgacctgctgatcctcgacgaaccgacgaccggcgtcgatccgctgtcgcgcgcccagttctgggaactgatcgcgcgcatccgggccgcccgcccggcgatgagcgtgctggtggcgaccgcgtacatggacgaagcccggcgcttcgaccggctgatcgcgatggacgccgggcgggtgctggcgaccggcagcccggacgagctgctggcccgcaccgggtgcgacacgctcgaaggcgcattcgtcgcgttgctcccggacgcgcagcggcgcgggcacgagccgatccggatcgcgccgtttcagcccgaacccgccgccggctacgcgatcgaggccgacgggctgacgatgcggttcggcgatttcgtcgcggtcgatcacgtgagcctgcaaatccgccgcggcgagatcttcggcttcctcggctccaacggctgcggcaagtcgacgacgatgaagatgctcacgggcctgttgccggcctccgaaggcacggcgacgctgttcggccagccggtcgcggccgacgacatcgacacgcgccggcgggtcggctacatgtcgcaggggttttcgctgtatggcgagctgaccgtccggcagaacctcgtgctgcatgcgcgcctgttcggcgtgccggaggcggacgtaccggggcgggtcgacgaaatggccgggcgcttcgggctcaccggcgtactcgacgcgttacccgaaagcctgccgctcggcatgcggcagcggctgtcgctcgcggtcgcgatggtgcacaagcccgaactgctgatcctcgacgagccgacgtcgggtgtcgatcccgtcgcgcgcgacgacttctggcggctgatgatcgagctcgcccggcaggatcgcgtgacgatcttcatctcgacgcacttcatgaacgaagccgagcgctgcgatcgcatctcgctgatgcacgcgggccgggtgctcgccagcgcgtcgccggggaactcgtgcgcatgcgcggcgccggcacgctcgaggaggcattcatcgcgtacctcaccgacgcgcagcgtgcggacagcgtcccgatggacgccgcgtccgacgcgggctggctgaacgcgccgcccgaggcccccgccgcccgggccggcaccgcccgcgcggccgcgtggttcagcccggcgcgtgccggcagctacctgtggcgggaagtgctggagctgcggcgcgacccgctgcgcgcgacgctggccctgttcgggtcgctcgtcctgatgtgcgtcatcagcatcggcatcagcctcgacgtcgacaacctgacgttcgcggtgctcgaccgcgaccagtcgatcctgagccaggactatgcgcagaacctcggcggctcgcgctacttcgtgccgcgcgcgccgctcgcggacgagcgcgagatcgaccgccgcatgcgcaacggccagctgtcgctcgcaatcgagattccgcccgggttcgcgcgggacgtcgcgcacggccgccgggtcgagatcggcgcgtggattgacggcgcgatgccgatgcgcgccgagacgatccgcggctacgtcgccggcatgcacgagaactggctgcgcgaccaggcgaagcgccggctcggcgcgtcgctcgcgccggccgtcgagatcgccgtgcgctatcgctacaacccggacgtcaggagcctgccggcgatgattccggccatcatgccgatgctgctgctgatgctgcccgcgatgctgacggcgctcgccgtcgtccgggaacgggagctcgggtcgatcgtcaacctgtacgtcacgcccgtcacacgcgcggaattcctgctcggcaagcaggcgccctacgtgatgctcgccatgctgaacttcctgctgatggtcgtgctggccgacgtcgcgttcggcgtgcggatcaagggcagcttcttcacgctcgcggccgcggtgctggtcttcaacgtggtggccacgggcatcggcctgttcgcgtcgacgttcacgcgcagccagatcgccgcgatcttcatgacgatcgtcggcacgctgattcccgtcgtgcagttctcggggctgctcacgccgctgtcgtcgctggaaggcgccggcaagtggatcggggcaatctacccggccacctacatgctcgcgatcagccgcggcgtctacaacaaggcgctcggcctgggcgacctgtcgtcgcagttctggccgctgctcgcggcggcgccggccatcctggccatgaccgccgtcctgctgcgcaaacaggagcgctgaccatgtcgcgcctgctcgtcatcttccggctcggggtcaaggagctctggagcctcgcccgcgacccgatcctgctcgtgctgatcgtctacacgttcagcgcgtcgatctacgtcgcggccaccgcgcgcccggaaacgctgcacaaggtgccgatcgcgatcgtcgacgaagacgcatcgccgctgtcggcgcgcatcgcgtcggcgttcttcccgccgcagttcgcaccgccgccgatcgtcaacgcggccgcggccgatcacggcctcgacaacggcgactacacgttctcgctcgacattccgccggatttccagcgcgacgtgctcgccggccgtcacgcgacgatccagctcaacgtcgacgcgacccgcatgacgcaggcctttaccggcggcggctacgtgcagcagatcgtgtcgggcgagatcgacgcattcgtgcggcgctatcgcggcacctcgtcgccgcccgtcgatctcgcgatgcggatgcgcttcaacccgaatctcgacgaagtgtggttcggcgcgctgatggagctgatcaacaacgtgacgatgctgtcgatgatcctcaccggggccgcgctgatccgcgaacgcgagcacggcacgatcgagcatctgctcgtgatgccggtcaccgccgcggaaatcatgctcgcgaaggtctggtcgatggggctcgtcgtcacggtggcggccgtcgcatcgctgacgctggtcgtgggcggagcgctgcacgtgccgattccgggttccatcccgctgttcgtggccggcatggcgctgcacctgttcgcgacgacgtcgatgggaatctttctcgcgacgctcgtgcgcagcatgccgcagttcgggatgttgctggtgctcgtgctgctgccgctgcaactgctgtcaggcggactgacaccgcgcgagagcatgccgctcgccgtgcaggacatcatgctggccgcgccgaccacgcatttcgtcgaactcgcgcaacgcatcctgtaccgcggcgcgggcctcgatgcggtctggatccagttcgccgtgctgttcgcgatcggctgcgcgctgttcctgctgtcgctgacccgctttcgcaagacgatcgcccaaatggcgtaaccggcccggcaggcggccggacgcccgcgcggcggccccattcgtccgttgatacagatcaaccgtgccggcacccttcacgcgatcatgacgacacgtcttgtgatagccgcggcggccgcgatggcggcagggcggcatcgcgctcacggcggccggcggccgcctcgccggagaacgtcatgatgcgcctgccaaaccggatcgttcttgccacgctcggcgtgttcaccgcactcgcgtcgctgctgggcgtcgagcacgcgatgctcgccggggcgcccgtcctcccgtacgcggtcgtcgcgctggtgtcgggcgtcgctgctttcgtcgcacagttggcttcggccgccggcgagcgcaggcgttgtgcgaggtgtcgatgaggcgaacttcggcgagcggccgctgatcgtcgggccgtccggcagcggcaagacgacgctgctcggcgtgatcccgggctacgtgcagttgctggtcgccgacgtgcaataccatcaggcgcgccttgcgtggctgcaggcagtcgcgcagcggttgcaggacacggtcgcgttctacgtcgcgctcggcggcggctggggtgacccgggctgaaacgcggcagtgcggtcgtccggagtcggcccgtctacgtatgcgccacgatgtccggccgctgccagggcggcaactcggcccagccgagcgggccgtagacggtaccgccggcggcctcgatcgtctcgacgaattcggcgagtgtcgcccccgccggaacggccagcttcatcgcgtcgacgaattcctcgctgcgcaaccacggcaccgcgccgccgttgatctgctcgacgctccagtcctgcccgtgccggccggcttcgggcggcagcaggcgcggcgcgtcgaacgccacgcgcagcagctgagtgcgcgaatcgctgtaaggcggctgcgcgacgtcctgatagggcacgtcggcccagctttggccgcactgcaggtcgagcggcaggcacgtaaaccacgcccagggcgcgcggacgaagcacagccggtagccggtccgcgcgccgtccaggttggcgatcagcgtcatgatggattcgtccctatcgcgtcgaaatctcgctgcctatggtgtgtacggcatatacgcggcccgcgcggagggcggaatcacgacatcgccctcgcgcatgcgaccactatcgcgccaccgtccggcccgcgcgttgattgacgtcaaaccgtagccgcaacggctggaggacgaacctcacctatcccgggcacggatacggcaatccctgatttccatcaatcgcttcacgcgcatccgcgctgtaatcggttcactgctccctcgactcccggtgaggcatccatgaaactgacttttctcggcgcgaccgaaaccgtgaccggctcgaagtacctgctcgagcacggcaaccggcgcgtgctggtcgattgcggcctgttccagggcacgaagaacctgcggctgcgcaactggagcccgttgccgctcgcgcccgacacgctcgacgcggtcgtgctcacgcacgcgcatatcgaccataccggctaccttccggtactggtgcgcgaaggatatcgcgggcccgtgtactgcacggccgccacggccgaactctgcgacatcatgctgcgcgacagcgcgcggttgcaggaagaggaagccgacttcgcgaaccgccacggctactcgaagcatcaccccgcacagccgctctacacgctggaagatgcgcagcgcgcgctgcaactgctgaagcccgtcgcgttcgacgaatgcaccgcactgggcggcggcctggcgttccgcctgctgccggccgggcacatcctcggcgcggcgagcgtcgtgatgcactggaatcacaaggtgctcgcgttctcgggcgacctcggccgctatcacgacccgatcatgcagccgccgctggcgcccgcgcatgcggacttcctggtcgtcgaatcgacgtacggcgaccgtctgcatccggaatcggaccccgagaacgaactggccgcgctgttcgacaagactttcgcgcgcggcggtgtcgtggtgatgccctgcttcaccgtcgggcgcgcgcaggaaatcctgcactacatcgcgcggctgaaggcgtccggccgcatggcgcgcgtcccggtatatctcgacagcccgatggcgacggatgtgaccgagatctatcgtcaccatattctcgagcaccggctgacgccgtccgaagcgaatgcgctcggtcacgcggccacgatgatccggtcggtcgagcagtcgaaagcgatcgccgaccatcatggcccgatggtcatcatcgccggcagcgggatggcgacgggcggccgcgtgctgcatcacctcagccgctacgcgcccgatgcgcgcaacacgatcgcgctggtcggctaccaggcggccggcacacgcggcgcggcgctggccgcgcacgagccgacgctgaagattcacggcgaatacgtgcgcgtgcgcgcgcaggtcgagtcgatcacgacgctctccgcgcatgccgactacgaggagattctccgctggctcggcacgatgcagcgcgcgccggtgcggaccttcgtcacgcacggcgaacccgcggcggccgatgcgatgcggcggcgtatcgcggagcgactgcactggccgtgcgaggtgccgacttacgcgcagtgcgtcgatctcgatgcggtcgaatcgggcgatacgcacgagccggccgcgctttcatcctgacggcgacgccgtcgacgcccgggccggcgcggcgggaaccggacatcgcgcgccgggttccgtgctcgcgccgcgcggcgatcggcgatcggcgatcggcgatcggcgatcaaccgacttcgatgatgaccttcagcgcatgggtttgcgccgcgcggccgaaggtgtcgtatgcgcgctcgacgtcgtcgagcgagaaccggtgcgtgatcaggcgcgtcggatcgaggcgcccggcgcgtacggtcttcagcagcatcggcgtgctgaccgtgtcgacgagccgcgtcgtgatcgagatattgcgatcccacagcttctcgaggtgcaggtcggccttgaccccgtgcacgccgacgttcgcgaccacgccgcccggcgccaccagcgaggtgcacatctcgaacgtcgccggaatgccgaccgcctcgatcgcgcaatccacgccgacgccgtcggtcagcttcatgacctccgccaccgggtcgccgctgcggccgtcgatgcaatcggtcgcgccgaaacgccgcgccacctcgagccggttgctgtccgggtcgatcatgatgatccgcgcgggcgagtagaactgcgcggtcagcaacgccgccagcccgatcgggcccgcgccgacgatcgcgaccgagcagccgggctgcaccttgccgttcagcacgccgcattcgaacccggtcggcaggatgtcggacagcatcacgagcgcgtcctcgtccgcgcccggcggaatccggtagaggctcgtctgcgcatgcgggatgcgcacgtactcggcctgcgtgccgtcgatccggttgccgaggatccagccgcccgtcgtgcagtgagaatacaggccgcgccggcagtactcgcagcggccgcacgacgagatgcacgaaatgagcacgggatcgcccggcttcagtgaatcgaccgcggcgccgacctgctcgacgatgccgacgccctcatggccgagaatgcggccgggttcgcacgtcggtacgtcgcccttgaggatatgcagatcggtaccgcagatcgtcgtgcgcgtcacgcggacgatcgcgtcggtgggcgactgcagttccggcctgggccgctcctcgagcgccttgcgcccgggcccgtggtagacgagtgctttcatcgcggttcctccatcgaaagaaagggttgcgggttcattcatcaggactgcaggtgatgccgaccctgcgccagcaccgtcgcgagcgcgcacgaagcgatccggacggcgatgccgtcggcacggctcgtcagcacgatcggcacgcgtgcgccgacgacgatgcctgcactgacggctcccccaggtattcgagctgcttcgcgagcaggttgccggcttcgatatcgggaacgaccaggatgtcggcgcggccggctaccggcgaatcgatcccttgtcgtgcgccgcccgcagcgaaatcgcgttgtcgaacgcgagcgggccgtcgacgatcgcacccgtgagctggccgcgctcagccatcttcgcgagcgcggccgcatcgagcgtcgagcgcatcgccggattgacggtttcgaccgcgcacagcaccgccacgcgcgggcaggcaacgcccagcgcatgtgcgacgtcgatcgcgttctgcgtgatggccgccttctgcgcgagatccggcgcgatgttcaccgccgcgtcggtcaggatgaacgggcgcggatacgccggcgcctcgatcaggaaacagtgggacatgcgcttgtcggtgcgcaggcccgaaccggccgcgacgaccgcgcccatcagctcgtccgtgtgcaggctgcccttcatcagcgcgccggcgcggccggccgccgccagttcgaccgcgcgggccgccgccgcatggctgtgcggcacgtcctcgatcgtccacgtcgaaagatcgacgcccgcctcgttcgccacgcgttgcaccttggcgcgcggcgcgacgatcagcggttcgatcgctgccccaggggtgacgtgcgcagcgccgcgagcgcaacgaggctggtcgcgtcacacggatgcacgacggcgacgacgagcggcgccgcgttgcgcgcccgcgcgatcagctccggtaatgcgccgtccgtgcgtggcagcaagccgggcaggcaggcgtcgtcgagccctccggcggcgggttttcgctcatgttgcgagtacgtaggtgccgggcgccgccgccaaccccgcggccggcgtacgggccggcacgtcgcccgacgagcgcgcgtgcagccagtcgcgccagcaggtccaccacgatccgtcgaccgccggcgtatcgcgtacgaaatcgtgccggctgcggtaggccgcgccgggttcgcgggtcgcgcatcgatagtggcgccccgcatggccgggttcggacacgatgcccgcgttgtgcccccgatgtcagcacgaaggtcagcgcgtggtgcgtgagcaggtggagcttgtagacggaaccccacggcgacacgtgatcgcgctcggtgccgaccacgaacgtcggcacgtcgagatccgacaacgcgaccggccgcccgtcgacgcagtagcggccggccgcgagatcgttgtcgagaaagagccgcgtcaggtattccgaatgcatccgatacggcatgcgcgtggtgtccgcattccacgacatcaggtcgttgggcttcgtgcgcgtgccgagcaggtattcgctcatcatccgcgaccagatcaggtcgcgcgcgttcagcagttcgaacgcggcggacatctgcgcgccgtccaggtaaccctgccgccacatcagcgcgtcgagtgcggacagttcgctcgcgtcgatgaacaggccgagctcgccgggttcgctgaaatcggtctgggccgccagcaacgtgacggagcgcagtgcgtcgtgttgccgcccgtcacgcgcgagcgccgccgcgccgatcgcgagcagcgtgccgcccaggcaatagccgaccgcgtgaaccgcttcgccgcagatcgaccgggcggcgtcgagcgtcgccatgcacccgtcacgcagataatcgtcgagcccgacgtcgcgggcctccgcgcccgggttgcgccacgacaccgcaaacacggtgtagcccgcatcgaccaggaagcggatcagcgagttgtgcggctgcagatcgaggatgtagtacttcatgatccacgacggcacgatcaggatcggttcgcgcgccacggcgggcgtcgtcgggtcgtattgcagcagctcgcacagcgcgttgcgccagacgacgcgccccggcgtaaccgccacgtcgcgtcccggcagatacgtgcgcgtgtcgcgggcccgcgtgccgctcgtgcgatcgagcaacgcgctcgcgtcgtccagccagttccggaagcctgccgcgagattcgcgccgccgctgcgcatcgtcgcgtcgagcgcgaccgggttggtcgccaggaaattgcctggcgagcacgcgtcgagccactgtcgcgcgacgaacccgaccagttcctcgtggtgccgttcgacgcccggcacgccgcgcgttgcgtcgcgccaccagcgctggatcgacaggaaactgtcgcgatacgcgctgaacggccagccggcccacgccggcgcggcgaagcgcggatcggcctcgccggcatgcacggcaaggccgctcatgtccgcagcgtcggcgtcgccctcacgccggtttgccgccggtgcaacggcggccgtgcacgcctgcgtcgcgagctcgaagcacttccccggcgacaccgccagatgcgcgccccaatcgagcatggccagcgccagcgatacgggcgacagcccgaaggtcattgcggcgacgctcgcatgcgctgcgcggttccattgttcggcaggcgaagtcgttcccgccgggcattcggcggaacgcgacacctgcccgccccgatccggcggcggattcgattcgtgcgtgaacggtgcacggatgacggaagctgtcattgcatgtgcatgccgccgttgacatcgaattcggcacccgtcgcaaatgcgcccgcatcggaacacaggaagccgacgagcgcggcgatctcgtcggggcggccgagacgccccaccgggatctgcggcaggatcttcgtgtcgagcacttccttcggcaccgattcgagcatcgccgtatccaggtagcctggcgcgaccgtgttgaccgtcacgccgtgacgcgcgagctcgagcgcgagcgccttcgtgaagccgtggatgccggccttcgcggccgcgtagttcgtttgcccgtacgcacctctcgaaccgttgacggacccgatgttcacgatccgcccgaagcccgcgtcgatcatgccgggcacgaacggcttcgtcatgttgaacatgctgtcgaggttggtgcgcagcaccgcatcccacatgcccttggtcatcttcacgaaggtggcgtcgtgcgtgatgccggcgttgttgacgagcacgtcgacgcgcccgaattcggccagcacgcgtgccgcgcagtgctggcacgcatcgtaatcggcaacgtcgacctcgtacgcatgaaacgcgcggccggcgtcgcgttcctgcgtgagccacgtcgcgacgtggtcgttgtgttcggtgtgcgacaccgccaccgtcatgcccgcgtcgtgcaggcaacggctgatcgcggcgccaaggccgcccattccacccgtgacgaacgcgacgcgcctagcggacatgatcgtgctcccgcgcggcaaggtggtcgtccggcagtcgcatggccaccggcccgccgtcgctcgcgccgacggcctccgtgatgccgagctcgaacgccgccatccagtcgcgccacggcatgctggcctcgttgatcacggccagccgcccgaggtcgggcagccagtcggtctggtagcgcgccagcccgccggggccgtattcgcgcagccacgtgcgccacgcgccggcactctcgaactgcccgcgcatgcagagctcggtggcgtcctgccagatcgcgacggtggcgaccgtgtagtcgcgcatcgccagccgggccgcttcaccgaaggccgtccactcgttcgtagccgtgagcgcctgctgcaggccgcgcacggcgtcgcggtcccgttcgatgcagcgccccgcgagcgcatgccattcctgctgccagcctcggttcagcgcggccatgcgcaatgcaagatcgcatcccgcgcggcaagcgtcgttcggtgtcgtcaaagcatgggcgctcatcgtgttccctccttcgatccggtcaacgggttcgcatccgcctcgtgccgcctgccgggcatcggcatggcgaccgcctcactgtgcggccgcggcgctcggctgccgttgatctgagtcaagcgcgcggaaaccctgcttcgtagactggattgcactggcggatcacccgtcgatggagcgattccgatgagctacaaaagcatggtcgtgcacctcgatacgagcgcccgcgcgcattcgcgcctcgagttcgcgttgcgtctcgcccggcgcttcggtgcgcatctcaccgggctgttcgcggtctacacgcccgagccgtattcgttctacgtgatggccggttccgccgactatttccgcgagcaccgcgagcggcgcgacgaacggctcgccgcgctggaacgcctgttccatgcggagaccgcccgcgccaaggtgccggcgacctgggttcgcgcggacgaacgcgcgaatcaggccgtgctgcgcgccgcgcgactcgccgatctcgtgattgcgggccagagcgacccgaacgatcccgagacctttatcgacgaccagtttccggagaacctggtgctgtccgccggccgcccggtgctgttcgtgccgtacaccggagaatttccgtcgatcggcgaacgggtcttcgtcgcatgggacggcagccgcgaagcggcccgcgccgcgcacgacgcgctcccgtttctcgagcacgcgaagcgcacgacggtcgccgccgtggtcgacgccgattcggaggcggcgaccacgcgcattccggccgccgatgccgcgctgatgctggcacgccacgcgcacgacgtgaacgtgctcgacatcggtaccggcaccggcgcgtcgatcggcgacacgctgctgtcacgcgcgtacgaaacgggttccgacctgctcgtgatgggggcctacggccatccgctggcgcgaactggtgatgggcggcgccacgcgcacggtgctggggtcgatgacgctgccggtgctgatgtcgcactgagccggccgatgcgcacgctcgcactcctcgtcgtcaatgccggttcgtcgagcgtgaagttcgcgctctttgcgtatccgccgcacgacgatccgcgcggcggccgctgcacgagggcgaagcggtcgagaccggcaacggcatgtcgatccgcttcgacgccgaaccggccgttgcattgccgctcggtgcgagcgacccctgtcgcgacgcgctcgcgcggatcgcgacgtggatccgcgggcagttgccgcacatcacggtgggcgccattgcccatcgcgtcgtgcacggcggcacacgcttcatggagccggtgatcgtcgacgacgcggtgctcggcgcgctacgcacgctgacgccgctcgccccgttgcatcagccgcacggcctcgacgcgatcgacgtgctgcgcggcgcgtttccgggcgtcccgcacatcgccgtgttcgacacggcatttcatcgcacgctgccgcgcaccgagcagttgctcccgctgccgcacgcgtggttcgacgagggcgtacggcgctacgggttccacggcctgtcgtacgaatacctggccgtcgcgctcgacgagcggttcggcgcgcgtgcgcacggccgcgtgatcgccgcccatctcggcagcggtgccagcctgtgcgcgatgcgcgactgccgcagtgtcgcgacgacgatgggcttctcggcactcgacgggctgatgatgagcacgcgctgcggggcgctcgatcccggtgtcgtcctgcacctgctcgaagtcggcaagctgtcgggcggcgcgctgggccacctgctgtatcacgagtcggggctcaagggcgtctctggcgcgtcgggcgacccgcgcgtgctgctggcacgcgaagccgccggcgatgcgccggccgccgatgcgctggcgctgtacgtccatcgcatcgtgcgcgaggccggtgcgctgaccgcgctgctcggcggcctcgacatgctggtcttcacggccggcatcggcgagcactcggccgtgttgcgcgagcggatctgcgcatcgctcggctggctcggcatcgacctcgacgtgtgcgcgaatgctggccatgcgcaggtcgtgtcgtccgcgtcgagcgcggtcacggtggtcgtcgagccgaccaacgaagcgtggatcgcggcacgcgccgcggtgcgcgtgctgcgcggcaaccgcgccgcttgatccagatcagcgccgtcggcacgcacgcgccgatgatgacctcatccacatccgttcaagggaaatgccatgtactcgaacattctggttgcgctcgacggcagcgacacgtcgtcccgcgcactcgacgccgcgctgacgctcgcggcggagacgggtgcgcggctaaccccgtctacgtcgtcgatttcctggtgcccgcctacgacacgtacggatacgatccgtcgatcctcgtcgacgccttccgcgaagaggggctgcgcgtcaccgacgacgcggcgcgacgcctgaaagcgcgcgacgtggccggcacgccgcagatctccaacgtcgagcccgcgggcgaggacattccgcgccggatcgtccgtcttgccgacgaaaccggggccgacctgatcgtgatgggcacgcacggccggcgcggcttccagcgcctcttcctcggcagcgtggccgagcgcgtgctgcgcctggccacctgccccgtcctgatgattccggcgaactgcccgtcggagaaacccgccgaaaccgccgcggcatcaaccgaaaaggagccgtcatgagctacaagaccctgctcgtccacctcgacgacagcgagcgctgcgcgacgcgcgtcggcctcgcactcgaactcgcggcgcgctggaacgcgcatctgatcggcctctacgtggtctgccaggacctgttcgagccgttgcggcggcccgacgaaccgctgaagcttgccgtgtacgagcggctgtgcgagcagcgccgcaaggaagccgaggaaaattcctgacggccgccgagcgcgcgggacgcagcgtcgaatggcaggcccccaccggcgacgcgaccgccgccgccattctgcacgcgcgtcacgccgatctgctggtgctcggccaggaagaccccgacgatcgcatgacctacgtcgcgcgccatttcgtcgaggatgtcgtgatgggcagcggccgtccggcgatcgtcgtgccctatgcgggcgacgtgcgaacgatcggcgagaacgtgctgatcggctgggacggcgggcgcgaagccgcccgcgtgatggccgatgcgctgccgctgctcgcccgcgcgcgcttcgtcaacgtcgagacggtcgtgcgcgggcagcccgacccgacaagacgcccgcaggcgtcgacgtcgccgcgtatctcgaacggcacggcgttcgcgcgtcgttctccacgacgccgcgcgaccggtcggtcggcgtgggcgcgaccctgctgaaccgggtgaccgacctgcacgcggacctgctcgtgatgggtttgtacagccatgcgcgcatgcacgaacgcgtgctgggcggcgccacacgcacgatcctcgagacgatgacggtgccggtgctgctgtctcactgagccgtcgaaaggggcagccgcttgcggccgcccctttcgtcacaacacagccgcacacgcgccctgcccctcccgcacgaccagcaccggccggtcggcggtgcgcaccagcgattcggcgacgctgccgagcaacgcgcggcgcacgccgcgccgcccgtgcgtgcccatcacgatcagctccgcgtcgcattcggcggcggcgcgcgccagaacggacgacacgtcctcgccgcacgcgtcgagcgtgtgtgccgtgccgcggacgccgcacaggcgaaacgcggtctccgcgtccgccaccgcgatcgcggccctgtccgcatccagccccgccgggtcgcgctggccgatatagccgctgtcgacgtcggccaccctcggcgcgtccgataccacgcacacggcgacgatcaggccgcctgaatcgcgggcgagcgcgatcgcctcgtcgagcgcgagtcgcgaagcgcggctgccgtcgagtgccgcaaagatccgtgcatacatggagcctcccgttgccgttcggatttgaccggcatgccagaccagtctgggcccgacgcgcatcgtccggttgacgccggtcaagcccgcacggaaacaggcgtacgcatcggtcccgattggcgaatccggacaaaacgcgcacaatttcgggcgatatcgcagtttcggcctgccccgcttcccgtgccccgcgtccggcccgccgcccgccggccgccggcgaaatccgtcaggatgaacggcaatgacagtccatgtgcccgccttcaaggccgggccggctccgcgcagggtccggcccgcgcgatccgcgaccctcgccgcgctgctgacgctggcgctcggcctggccacgtcgtttgccgccgcccggctcgtgcagaaccgggcgcaggaagccgcccaggcgcgcttcgcgcaatcggcgacgctcgcgacggccgacctccggcgcagcttcctcggcgccgccgccgtcttgcgcggcgcgcgcggcttcgcgtcgacgctggtcgtgcctcaatccggcgacgcgtggcgtcgttacattgccggtctcgatctggacggcttgcagtcgcccgtccgcagcgtcgggagaatcgagccgagccccgccaatgacgatcaggcgacccggcgggcactgcagcgagcggcggaaaccggcagggtcgcgctggccgcgaacgcgacccgggacagcgccgacgcgacgagtgcccgcacggcgctgatgttgtatctgccgatttatgcggacgctgaagacggggctccgccggggccgcaacatgcgcgcgcgaccggatacgtctatgccgcgctcgatccggcacgtctcgtcgatccgtcgatactggatcggctacgcatggaaatcgcggccgacatcccggcggcgctcgtccatgccggcggcttcggcggcaacgacgccacggccgccggcaacatgctcacgcgaacggattcgctgtcgttcggtggtacgccgctcacgctgcgctacagtgcgccgggcccggacacgtccggccccgcgctggccgtgctggcggccggcaccgcgctgtcgctgatactggccgtgctcgtgcagcaggttgtctccacgcgaatctccgccgccgtgcccgccggcgacggccagccgaccggggagcggatgatgggcatcatccggtcatcgatggaagcgatcattaccgtcgacgaaagccagacgatcgtgatcttcaatccggccgcggaacgcgtgttcggcgtctccgcgatggaggcgatcggcgcgccgctcacccgcttcatccccgagcgctttcgcgccgcgcatgcgcggcacgtcgagcaattcggcgtgacgggcgtgtcggaccgccagatggggcagcaacgcgtgctgttcggcctgcgcggcgacggcacggagttcccgatcgaggcgtcgatatcgcagattcgcgacggcgcgggcaagctgtacacggtcatgctgcgcgacgtcaccgagcgcgtccgcgcggaaaatgcgctcaggcagtcgcgcgaggaactccgcgagctgtccgccaacctgcagaacgtgcgggaggaagaaaaacgcggatcgcgcgcgagttgcacgacgacctcggccagcaactcaccgcgctcaagatggacctctccgccgtcgagctggggctcgcgggcattgtcgcccccataccggcgtgcgcgagcagttgggcggcatgcatcgcctgatcgattcgaccgttgcgtcggttcggcgcatcgcggccgatctgcggccggtgatgctcgacgacctgggtctcatcccggcgatcgagtggcttgcaaacgatttcacgcatcgctaccggatcacggtcgaccgggacatcgcccccgtcgataccgcgttcaccagcgccggcgccaccacgctgttccgcatcgtgcaggaagcgctcaccaatgtcgcccgacatgccgatgcgacgcacgtgaagctcgccctgaaagtggaagacggctactgcatgctgcgcatcgcggacaacggccacggtgcgccggaggtcgcccgcgacgagcgcgatcgtccgtcgttcgggctgatcggcatccgtgagcgcgcgcacatgctcgacggcacggtgacgatcgagaaccggccgggaacgggattcacgattaccgtggcgttgccgcttcacgccatccagcaaggagatgtgctgtcatgatcagggtactcatcgccgacgaccacgccctcgtcagggacggcctgcggcacatcctgcagaacgcaagcggcttcgaggtcgcgggcgaggcgtgcgacagcgcatccacgatcgcactcgtgcgcggcacggccgcgaacgtgctggtgctcgacctgtcgatgcccggccggaacggcgtcgaactcatcaagcagatcaaggacgagaaaccggccttgcatgtcctcgtgctgacgatgcacgccgagcagcaatacgcggtacgcgcgttccgcgcgggcgcatccggctacatgaccaaggagagcgcgagcgccgaactggtcgcggcgctgaccaagatcgcggccggcggcgtgtatgtcagcctgacgatggccgaacagtttgcgcagagcctgaacgaaccgaccgatctcctgccgcaccagcgtctgtccgaccgtgaattcgacgtcttccggcgcgtcaccaccggcgagtcgatttccgaaatcgcgaaggcgctctgcgtcagcgtcaagaccgtcagcacgtacaagacgcgcattctcgagaagatgcaaatgccgaacgacacggcgctcgtgcgttatgcgatgcgccacaagctgttcgacgacccggacgaactctgacggccgccaggcagccggctgcttgcgccgacgattccgctgccagtggccgcatgggcggctcacgatcgcgcgaccggctcctcgacgctgcgtcgcgtgatatcgaacataacgtccgccaccgccgccggcattgagtcaggtcaacggaatcgccgcccgttgccgcccgcctctcgacaacgtcgaccgggcaacgcgcgcccgcctcggcggcaagatcgcggcaagatgccgcccctttgtaggaaacgccctacaacgcttccacgtgtcctaccgcatcttcaattccggctgatttccgtcgagcgccgcgccatccatactgcgtatcaagaaaaacaagccagcgtgccgcccggagcaaaggccctcaaccccgagaccggtttcggtctcctggcccgtccggtgtggttccccatcaggaaggcggcagacaccaaggccgccggtacgacggccagcgcgatcctgcccgacagcgattcgccgctggcccaggaattggagccgatcatgcaaagccatgccgatgtttcgcagaccatgccgttacacccgttacaaccgtcacgtccgttcatcccgctgcatcccgtcgaacgggcggaccagccgaagcgcgccgcgtcccgttgctcgacgtgcgcgctgcgtaccgtgtgcatgccgcccgatctttcgcctgacgacttcgcgcgcgtcgacgcgatgatctgcacgacgcggcacgtcaggcgcggcgaaacgctgtttcgcgcgggtgacgcattcaacagcatctatgcggtcagaaccggttcgttcaagaccatcgtgatgcatcgcgacggagacgagcagatcaccggcttccagatcgtcggcgaatcgctcgggctcgacggcgtgcacaccgggcgacacaacggcgacgcaatcgcgctcgaggacagcaccgtctgcatcattccgttcggccagctcgagcagatgtgccgcgacgtacggccgatgcagcatcacgtgtatcagatgatgagcggcgagatcgtgcgcgaatccgcgcagatgctgctgctcggcacgatgaccgccgagcagcgcgtggccgccttcctgctgaacctgtccacgcgcttcaaggcgcgcggctactcggccgccgaattcgtgctgcggatgacgcgcgacgagatcggcgagtatctcgggatgaagctcgaaacggtcagccgcatgatgtcgaagttccagcgcaagggctcgtcgccgcgcaaggcaagcagatccgcatcgtcgattcggacggcctcgggcgcatctgagcgcattgcggtgcgggcatgtcgagcgggatcagccgcgcatgccgagcacggcggcgccggatacgcgccccgcgcgcagatcgtccagtgcgcggtttgcatcggtcagcgcgtaacgcaccgcttcgacccgcagcggcatcgcatcggcgatccgcatgaacgcggccgcgtccgcacgcgtcaggttggcgaccgacgcgatgcggcgctcgccccacagccacgcgtacggaaagcccgggatatcgctcatgtgaatgccgccgcatacgacgatcccgcctttgtcgaccgcgcgaagtgcggccggcaccagtgcgcccaccggcgcgaagacgagtgcggcgtcgaggggttccggcggcgtttcgtcgctgccgccggcccatgcggcaccgagtgacagcgcgagctgctgggcgacggtgtcgccgggcttcgtcaacgcaaacaccttccgcccctcgaaatgcgcgacctgcgcgacgagatgcgcggccgcgccgaagccgtagatgccgacgcgacgcgcatcgccggccatgcgcaaggttcggtaaccgatcaggccggcgcacagggcggcgcggcctcgagatcggaatagcgccgcggcaggtgcacgcaatagcgatggtcggcaacggcgcactcggcataaccgccgtcgatcgtgtaaccggtgaatcccgggctgtcgcacaggttttcgcggccggacgcgcagtacgcgcaatgcccgcaggtcgagcccagccatggaacgcccacccggtcgccgacggagaatcccgtcacgccctcgccggtcacgcgcaccgttccgacaatctcgtgccccggcaccagcggcagcttcgggtgcgcgagttcgccgtcgacgacatggagatcggtccggcatacaccgcacgcgtgcacgtcgatcagcagctggcccggcgccggcagcggatccggcacgcgcgcctcgcgcaaatgcggcgtcgtaccgtcaaacatcatcgcaagcatgctcgcctccccgcgccatcgagttcgcgcgcgtcacgatgcaaggctagtcgccacgcgccgcgcgcgcatggcgcagtggcgggcgcttgacgtgggtcaacggcggccggccggttgctgacacgatgaagtggcatgacgccgcccgcccggccgaccaggagatgatcgaatgatatccgttccccacttgccgcaagcgcgcatcccgaagcgcatctgaggtcgctgctggcctatgcggtgctggccccgtccagccacaactcgcagccgtggcggttcatcgtcgacgggcccacgatcgcggtctgcgcggaccgcgtccgagcgctgccggtggtcgatccgttcgatcgcgagctgatcatcagttgcggcgccgccttgctcaacctgcgtgtcgcgctcgaccacgcagggctcgcccatacgatcagcacgtttccctccgaagtcgaccccgatctgctcgcactggtgcgggtctgcgacgacggctattccgacgcgtcgctcggcgcgctgttcgatgcgattccggagcgtgtgacgacgcgcgcgccgttcgaatcgacggccgttccggacacgctccagcgcgagctgatcgcggccggcgcggcggaaggcgtcgaggtcgcctgtatcgacgcgatcgcgcaccgcgcacgggtggccgagctcgtcgccgaggccgaccggcagcagttcgccgatccgcgcttccggcgcgagctggcgagctggatcgatccgcgccggcacgtcgacggcatgccggcattcgcggccggcgtgccgacgctgctggacttcgcggcgcccgtcgtgacgatggcggtcggacgttcgatctcggcaacgggctcgccgcgctgcatcaccagctcgtcggcgcgtcgccgctgatcgtctgcctgtcgaccgtccgcgacgatcgcgaggcgtggctcgccgccggacaggcgctggagcgcgtcctgctcgtcgcgacgcgcgcgggccatacggcgtcctacctgaaccagccgatcgagacggccgggctgcgcgcccacctgcgccacatgctcgggctgcgcggcgagccgcagttgctgctgcgcgtcgggcgcggcccgcatacgccgcattcgccgcgccgcccgctcgacgaagtcgtctcctgatcgcgccgcaaggcaaggtgcgcccctccgacccggacgaggataaaaacatgaacctcctgcgtttcgccgccctctgcgcgatcgccgcggcggccggcccggccgccgcgcagacggccgtgcccgagccgaccgatctcgtcaacgcgcagcactgcatgttctgccacacgcccgacatgaggttcctcgggccgtcgttccacgagatcgcgcagcgctatcgcggcgatccggccgccgccgcggaactggaacgcaagctgcgcgtcggcggccgcgtgcactggggcgacacgccgatgccgtccgccgaggatcgcggcggcccgctgtccgccgacgatgcgcatcagctcgtgcaatgggtgctgagccagtagccggcccgccggcccgcaccgcatgccgaccgccatcaaacgcctacccgcccgcacggtacgaggcaacgcgcgccgccgtgccgcacccggcgcgacgccggcggacacgcgcggcacacgcgcacgtacgcggcccgatgcgctcgccggcaacgacgacagcgcccggcccggcccgcgccgcgtgcggcgtcccgcccgacgcccgaagcgcacgcctgccgacgacgacgccaccatcctgcagcgcgcgagcatgcgcggcatccggctgcagctcgactactggaaagccgaggcgcgcctgcagagcgaaggcatcggccatgccgtcgtgatctacggcagtacgcgcatcgtcgcccctgccgtcgcgaatgcccggctggacgaagccaatcgcctgctcgcgcagcgtccgcacgatgcgggccggcgccgcgccgtcgcggcggcgagccggctcgtcgagcacagcgtgtattaccgcgtcgcacgcgaattcgggcgcatcgtcggccacgccgaccgctgcacgcgcgccgcgcggctcgccgtggtcaccggcggcggccccggcatcatggaggccgcgaaccgcggcgcatacgaactcggcgcgccgagcatcggcctgaacatcgagttgccgcgcgaacaggcgccgaatccgtatatcacgcccgatctcggtttccggtttcactatttcgcgatccgcaagctgcacctgctcgaacgcgcgaaagccgccgtgtttttcccgggcggctacggcacattcgacgagctgttcgaggtcctgacgctgctgcagacgcgcaagatcccgccgctgcccgtcatcctcgtcggcgaggcgtactggcgccgcgcggtggacctggccttcctcgccgacgaggggatgatcgatcgcagcgatctcgacctgttcacgtactgcgaatccgcccccgacatctggcgcgcgatcggaagctggtatgcacggcggcgtgcggcgcggccggtgcgccgccgtccgccgccgaaaccgcgtgccgtgtaggaatctgccgacgcgctccgcgcgattcctaccgcagcttcggggcatgccgattgaatcgcgcgggcgcggcaacgatactgaaaccacggatcgcggctgcgcgccagccggattccgggccatcaggagagccgtcatgacacacgctaccccgcttcccgattcgggcgaccaggcccgccggcctgacgctgccgcgctcgacacgcaggcgctcgtcgccctggcgcgcgacgccggcatgctcgtgatcctcgacggacagatcgggcgcgagcggtacgagagcgtgacgggctcgatcgccacgctggcccgctttgcgcaggcactgcaactgtcggcactcaaggccgcctgaagcccgcaaccgtgccgcgccgccggcatccggcgcgacggcggcggcccggtcttccgacgcaatgatcacgctcgccctgccgtcccgtccgtctgcccgggccggccgcaccccggtcaccacgcgcctgccgaagccgtccatcccgttcgcccggacgtctccgggatgaagccgcgatgaaccggcacctttcgaacacgtcgcccacctgtttccgggcatcgcactgctcacgcactaccggcgcgcatggctgtcgcgcgacctgtatgcgggcatcgcgctgtcggccgtgctggtgcccgtcggcatgagctatgcacaggcggccggcctgccggccgtcacgggcctccatgcgtcgatcgccgcgttgctcgcgtatgcgctgctcggcccgagccggatcctcgtcctcggccccgattcggcgctggccgcgctgatcgccggcgcgatcgccccgctcgccgaccatgacccgcagcgcgccatcgcgctggccggcgcgctggcgctgtcggccggcacgatctgcatcctgctcggcacgctccgcctcggcttcgtcaccgacctgctgtcacgtccgatccagtacggctacctgaacggtatcgcgatcgcgctcgcgatcggccggttgccggaactgctcggcatgcccgcggcgggcggcgacgtgttctccagcgtgccgcccatcgtgcacgccctcgccgaaggccggttctccaccgatgccgcgctgctgggcatcggtgcgctcgccaccattttcctgatgaaacgggtgatgccgcgcgcacccggcgtattgatcgcggtgctggcggcgaccgtggtcgcgcacgtgtcgccgctgcacggcatcgcgacggtcggcacgttgccggccggcgcgcccgtggcgcacctgccggtcgtttccgtcgccgacctgggcgcgctcgcgtccggcgccgtcgccgtcgcgctggtgtcgttcgccgacatcagcatgctgtcgcgcgccctgtcggcacgttcgggcgaaacgccggatcgcaaccaggaactggtcgcactgggcgccgccaatctgctggccggcatgatgcagggctgcgcggtcagcagcagcgcatcgcgcacgcccgtcgcgattgccgcgggcgcgcagagccaggtcacgaacctcgtcgcggcggcgtgcatcgcgatcctgctcgttgccgcgccgacgctgctgaccggtgtcccgcgcgcggcgctggccgccgtcgtgatgtacgcggcgttcggcatcgcggacgtccgcagcgtcgtccggctgtaccggatgcgtcgcggcgaatgcctgattgcggtgctgtgctttgccggcgtgatcggcatcggcgtcgtgcccggcatcctgctcgccagcgcgctgtcgctgctgtcgttcgtgtggcgggcctggcatccgtacgatgcggtgctgggccggctggccggcgtgcgcggctatcacgacatcgcgcgccatccggacgccgtgcagacgccggggctcctgctgttccgctgggatgcgccgctcttctacgcgaacgtcgagattttctgcgagcatctgcacgcggccatcgtatcgtcggcgtctccggtcacgcgcatcgtcatcgcggccgagcccgtcacggatatcgacgtcagcgccgccgaccggctcgtggcgctttgcgaggaactccgcgcgcagacaatcgcactggacttcgccgaaatgaaggggccggtgaaggatcgcctgcgcgcctacgggctgttcgacgcgttcggtcccgccagcttctttccgaccgtgaccgacgccgtcgcgcatcatgtccggctgcaacgcgaacatgcgcgcgacgacgaaccggttgcgcaccccgcgccgcctgccgaccgtgaccgcgctgacgggtaggcacaccgatacccgtgcgacgcggcgctcgttgcatcggatgacgaacgaaacgtcgacgcacgggagacacgttcacgtgcgccgtggcgtcagaccgtgaacgtgttcgatttcctcatctcgacccaggtcatcccggcgcgcagcccgtcgatcgcggcttcgcgctcggtatcgtgggtccggctgtgcgcgaacgtgcgctcgcatgcgccatccggcgacgtgaacgtcacgtggatcctgcaacggtagccgcccgcttcggcggcaatcgtctcgatcgtcaccgaccagtccgcgtcgtgtacctcgcctgacagtgtcatccggcttccctccttcaactgcgcggactgcccatccggttaccgggttccgcgcttactcgacgaccaggtcgtcgaccaccgcacgcacgccgcgcgccgaccacgcggcaccgcgcacggccttgcgctcggagaacgaaccgaccttgccggacagccgcacggtgccgtcgtgcacctcgatcgcgatgtgcttcgcctcgcgctccgcgtggcgcatgatcgcgcgcttgatgctgccgccgatgtcggccgacccgaccgccccctgcaccgtgatgtggtcggtcacgccggtcacgctgcgcatctgcgagatcgcccgcacggccatatggctctggtacgcccagtcgaccctgccggacagcgtgatccagccgtgttcgacctgcaccttgaccgcatcgtcgtgcagaccgaccgtccagtgcagaaccgagcgcacggcattcgcgatgtcctcgtcggtgcggacgtcgtcgtccggcagatgcaccgtcatgtcgacgacgagcgccttgacgcctgccacgcggttcgccgcacgctcgatcgccagtttctccgcatagctcggcgggtgacccgagagcgtcacgatccggttgacgacctcgacaccgatacgtgtcgcgtcgatcgccgggtcggactcgagttcgtcctggacgtcctgcttcagttgcttgtcggttttcatcgcctgcactcctgtgagccgcggcgtgcctgtccgccgcatacgcccagatttgcacatgcacggccggggatcgctgatgcaggtcaacggacgccgctcgacgcgcatcgcggcctgccggtgcaccgcttgacggaggtcaagccggcgcggcccggcggacttatcgtgagatcgccgatgcgcgacgccccgggcaagcacggcgatgctccaaggagactcacatgacggaacagcaactgttggcctattcgccgacaccaccggcagggccggtatcgccacagggcgaatccccgcccctcatcgacctgccgtacccggacctcgacggcggcccgccattgatgaccgcactcgcggcgagaatgagttcccgcgaattcgccgccacgcccctgccgcccgcgacgctcggcgcgatgctgtgggccgcggacggcgtcaaccggccggtcggcggcggccgcacggcgccgtccgcgcatgcgttcaacgaaatcgacgtgtacgtcgcgctgccgtacggcgtctatcgctacgacgcgcccgcgcatcggctcgtgctgaaacacgccgtggatgcccgtaacctgacgggttaccaggacttcgtcgggcgcgcgccgctggatctcgtctacgtcgtgcggaccgccgcgatcctcgacatgccgccgcagcagcgcgacgtgttctcggcgatcgcggccggcgccatcgcgcagaacgtgtcgctttactgcgcggccgccggcctcggcacggtcgtgcgcggctggatcaaccatcgcgtgctggccgacgcgctgcggctgaacgaggacgagctgccgatcctcgcgcagacggtcggctaccgcgcgggcggtgccgcatcgaatgcgtgagcgccccggcgcccgcttcaacgaaacggcgcgcggatcgctccgcgcgccgtctcctcctgtcgggcagcgcatgccggcgccacccgctgcctgccgcccgatcagccgatcgtcagctttttctgcgcgaccggcgccttcttcggcagcgtcagcgacagcacgccgtcctgatacgtcgccgttgccttcgcgtcgtcgatttcacccgacagcgagaacgagcggctgaccgcgccgctatagcgctcgcgccggatcacgcgctcgccttccttctgctcgctgttgcgctggattttcgcgttgatcgatacggtgctgcccgtcacctggacgtcgatgtcgtccttggcgacgcccggcagttccgcgttgaccttgtacgcatcgtcgctttccgtcacgtcgatcttcatcgatgcaagatcgggctcgtccgccagcgtcatccgcgcagcggcctgaacaggccctgaaacaggtcggcgacaggttcgatcgaaaacggatcgtaccgtgtgacattgctcatggttcgtactcctcgaacgattgacatgcggcccgcgctttcgtcccgcccgcgcgaagccatgacgaagatcggattggcgcggcaccgtgtgccgggcaacggacgaacgatcatcaagattccagcgtaactgcccgcatcggcatgtgcttgacgcgcgtcaacaggagcggacgctcaggtgcagaaccggaaatagccgctgtggagcaggatcggccggccgcccatctcctcgagcaggcagcgcgcggcgcgctcgatcgcgggtcgatgacgggcgaatgcctccacgagatcctgttcacgcggcgacgccgcgcggaagtgatcctccagcgcttccgcggtgatcgcgcagtgcacacggcggccttcgaccagcgcgggaaacgccagcgcgggatcctggctgcaatacgtcggatgttcgcaaggaaaggagatctgcatgatggtcacctgtgcaggttgcgcatgggtgggcgcgggctcgcgttgcgccgggtgctgcccgcgtcctcgccgcgaggcgccgcgcgcgaatacgctaggctgccgccgccgcggccggggcggcatcgccggcgcgtacgagcaggaccgggcaactcgatccgcgcaggaaacgctccgcgacgctgccgagaaacaaccgccggacaccgcggcggccgtgcgtgccgatcacagccagatcgatcgaacgctcgacgacgtaccgttgcagccgttcggcgacattctggccaggctcggtctcgacgatttccgtgtcgccgttgaccgccgcgtgcgagatcgcccgttccgcgctgcgcagcaccgccgcgccatcgcgccgaacctcgtcgagcagcgcgtccggatccattcgtccggcgtacgtcaccagaagcgagcggtcgacgacgaaaacggcgaacaggcgcgcgccgtacgatcgcgccaccttcagaccttcgtcgagcgccagtttcgatgaaggactgccgtccacggcgaccatgatgttcgtgtacataccgacctcgctggatgaaccgacgcgccggcggcgtgcggatgggtgtcatcatcggcgttcgccggacgcgggcgttgacggaggtcaacggttcgaaatcacgtggaggcgcgcgggcgcacgggcacgagacgccggatcagcgcggcgcgaccggctgcggcgcgccggggaacgcgcctggctcacgtcggcccggaagcctcgctcgatgtcgaggatcttcgtcgcgcacgcgtcgtaccgccaccccgggccgccatcgctgccgtacatgcccttgcacatcgccttgagccggatcaccgccgcgccgccgcccgatgcggtgcgcgaggcccacaaatagacttcgccggccaggaacggcggcgccgtctcgatcgtgtctgcatcggcccgggtgatccgggtcgacgaatgcccttcgacgtagcggcgcgcaaggcgccatgcgcggtcgcattcggccggtgtcgaacactgcagcgccgcggcctggcgcgtcgcgaacaattgcgtttccgtcgaccggaaggccgcgttccgctccgcatcggcgcacgcccccaacgcgagcaacacgacgaccgcccacacccgttgtttcatcttccctgcctcgcaacgcatcgcgttccgctcgccatccggcggcatgaatccgctcgacgccaacccggccgcgtgacgcaccgacatcccgcattcggtgcgcggtcacgtgccgcatcgcccgaacgcccgaatcgactgtagggccgccatggggaatgcggttgacctgcgtcaagcgcgtgccggcgcggtgcgtaccgcacgcgccgcaacggtgccgacgacgtgcatgcgggcggcgttgcgccgctaccgcgccggcgccgggccacggcaagccgtccgggtgcgcacagtcgacgcgcttgacacgcatcaagccgggatgggcgacagtcggctgcaatagggttcgtcgcacgcgtgcctccgagcctgccggcccgatcccgcgacatcgagcagacggagcgtaccgcttccgttcgactacaacccgcgggcacggcgccatgcaagcgccacgcccatcgatccgttcatcatgtcccgagcgccacgcctgccgttcacgtcgagccgcggagccgcacgacgcaagaccctgcaattcgatcgcgcgttgcgtcgacctgccacctatccgcatcccgccggccggatcgaacggatcgaaacccacctgtccgtcgtgtatctggcgggacgctacgcgtacaagcgcatcaagcccgttcgattcgcgttcgtcgatctcgtgcgccccgcgcagcgccgccgctgcgcgctggcggaatggtcgctcaaccggccgttcgccggcccgctgtacctgggcgtctggccgatcgtcgcgcgcggccgccgcagcactttcggcccgcccgtgcgaaccgcccccaccgccaccggcagccggcggtgcccggcgagtatgtggtgcgcatgcgccggttcgacgcgcaagcgatgttgtcggtccgcagcgcatcgcacgacacggggctggcggacgcggacgcattcgcgcagacgctggcccgccatcatctgcacgcgccgcgccgtgcgccgcgcggctacccgggcagcgcggcgagcgtcgcggcccaatgccaggcgttgtgcgacacgctcgacgtcacggtgcccgctcaagccgcgctgcgacgctggtacgaagccgagctggctcgtctcgcgccgcagttcgccgagcgggacgcgaacggcttcgtgcgcgcctgccacggggatctgcatctcgacaacgtcgtccgctggcgcaaccggatcctgatgttcgactgcatcgagttcaacgacgcgctgcgctggatcgacgtggcgagcgatctcgcgtttgcgtggatggattatgccgcccgcgggcgggcagattgcgcccaccgcctcctgtcaggatggctcgcaggtacgggcgaccatgcggcgctggccgtactgccgtgctacttcgtctatcgtgcgctggtgcgtgcgctgaccgcgcggctgcgcggcgacgaagcgacgcgcggccgctatctgcgcgttgcgtcggacatggcgcaggcacgccgcgatgcgcggccgttgctactgctctgccatggcatgtccggttccggcaaatcggtggcgagccgcgcgctggcggaacggctcggcgcgatccggctgtccagcgacgccgaacgcaagcgcttcgccagcgcaccggaggacacccgtctgccgcccgccgcttactcggagacggcgatcgacgcggtctacgacagactgcgcgcgcaggccggagaggtcctcgccagcggctatacggcgatcgtcgacgcgacgttcctgctccggcgcaaccgggcgcccttcatttcgctcgccgagcagcgcggcgtgcgcgtcgcgattctcgacttcaccgcgagcccggcgacgctcgccgcccgtgtcgcggcccgggccgcacacgggcgcgacgcatccgatgccgacacggccgtactggcccggcaggtcgagcgtgccgagccgctggccggagccgaggccgcgatcacgatccgcttcgaaaccgagtgcgacgtcgcggcgtacgggagccgcgcgttctgggcgccgttgttcgccgcgctacgcgcgtaaacacgcgcgccgcgccgcccggagcgcggccccgacgggcagcacgacgggcacgacgggcgccacgcagggtcggcacgtcaacgtgccgccacgcgggccgtggcgggccccgggcgacggctgcccatgatccgcgccctgcgcgacgcacggctgacttgacgccatgtcacgccgttccgtttcggccggccgcgacacgaacggggtcgcgcacttcgcccacctgcgcggccgtgctcggcgcgctcgtttccctcttcgtgcggaaaaagcgcggggacgtgcgagtgtagcgcccgttcccgccgcctggacgccgacgccgcctagatgctgagataccctggaacaaccacgggggccgcttcgatcccgcaccgcatggccgctcgcggccggcgcgcaggtgcccgaagcccggcgatccatccgcccagaacgacggcacgaaggaaaactcgccgttgaccgtcacgacgaagtcgcgattgaatggcgacggcgcgaagatcgtcacctcgcggaaaaacggcgcggcatcgtcgtgcaagataccgcccgcacgtgtccacctcgcgtcgtagcgagccggcaacgtatagatcctgccgccgcactccaccgttccggccggcgtgtacaccatctccactcccggatacggcaggcggtaaggctcgcggcaaaccgggccgtcgggtccgaccacgagcggcggatgcgcccagatcgatagcgacagcgggctcgtgtgctgtgcgaaatattcggaaagccagttcatggcccattctcccgtctacggtcattggcgtgcgcaggtgccggcaggttcgctgaagcggcgcgatcgcgccggcggcccgtcgagcgtcgcacgacacgctcgctgccgatcgcaaccgaaagcctgaacgactccgccggcaaacgcccggcctgtttcggcgcccgtgaagtcattctcgaacgcaccgcgcgccgggcgttgacggaagtcaacggacgcggcggcacaccacccgccgttgccgcgggccggggcccgcatgatcaacggccgaaggtgcgcgtatggtcgtcgtagtcgaacagccccgcgtagcggccccagtccgtcacgacgcgcagcgcctgttccgcgctgcgcggatcgagatgatcctcgagctccagttcgaaacgctcacgcggcgcgcgatgccctgcacgctcgtccagcacttcgtcgatatgcgcggcaagcggcacgaacttgacgacatgctctcgaaacaggcgccgccgggctcgtcgtcgctgtgcgcgaacacgtggcccgccgcgctcaaccggagggtccggtcgtgccactcggcaaaggcgagcagatggagcgccgcggcggtcgcatggagcacgtcgacccgaagcgcgagcgccgcggcaatcgcgccgagttccgcatggccgtcgtacggcgcggccgccagggtctcgacgaacccggcgagatggtggctcgtcacgtcgggtagcgtcatggccagcgtgccgccggccgccgcgcgggccgccgccgcgtcggcgatgcgcgcggtcagcgtcgcgtagatcttgccgacgatcgcctggaaagccgggtcgtgccggctgcgcggacgcggcaacggcacgttcagcgcggcgtcgatgcgcgccgggccggcgccgagcaccaggatgcgatcgcacatgagcacggcttcctcgatgttgtgggtcaccatcatcaccgaccgggtcgacagctggcgcgcgtcccacaggtcgagaaaatcggtgcgcagcgtttccgcggtcagcacgtcgagtgccgagaacggttcgtccatcaacagcaggacgggttcgctgacgagcgcgcgggcaaaccccacccgctgacgcatgccgcccgacagttcgcgcggataagccgattcgaaaccgtcgagcccgatcaactcgatcgcgacggccgcccgttcgcgcacgtcgcgtggcgaaaggctcagcgcatccagcccgagctcgacgttttcgacgacggtcagccacgggtacaacgcgaaggtctggaacaccaccgcaatgccggcggtcgggccggcaagcggtgccccgcgatatgcgaccgcgccggacgagggcttgacgagcccgcccgcgatccgcagcagcgtggacttgcccgagccggagcggccgagcagccccagtatctccccctcgcggagcgtgaggtcgatatcggccagcacgtgcagcggctcgccggacggcttcgtgaacgatttgcatacgccgcgcatctcgagcacgacgggagcctgctccgatgacggcgcggccgcgcccgcctcgtacgcttccttgcattcaccgggattcgacacatcggtctcctgcggatggacgatcgggtccggactcaatcgaaccgcgtcctgcgctcggcgaacgcatacatcgggcgccacacgagccggttggtcgcgatcacgagcagcgacatgacggcgacaccgagcgcgatacgcggaaagtcaccggcgccggtcatctgcgcgatgtaggccccagtccgccggcattcaggcgcgtgctgccccagctcaccgcctccgctacgatgctcgcattccatgcgccgccggacgcggtgatcgcgcccgtcacgaagtacggcagcacacccggcaacatgacgcgacgccaccaggtcgccggccggacccgaaagcatgccgccgcttcggtcaggtcggccggaaacgcgctcgctccggcgatcacgttgaacagcacataccattgcgcgcccaggatcatcaacagcggcagccagacttcgggggcgagccggtagcgcacgatgacgaacaccgcgaccggaaacaggaggttggccggaaacgcggcgagaaactgcgtgatcggctggatgcgggcggccacgcgcggtcgaagaccaatcgcaatgccgatcggcacccagatcgccgacgcgatcacgaccagcaccgtcacgcgaacgaaggtgagcgcccttcgcccgccacgacgcgcaggtccgcccaggtcagcgccgcgcgtccgagccggaacagtacaaccgccgcatacccgcatcccgccgcgcacagcgcgaaccagagcgcgtcacccgcgtgccgcggcagcgccatccggccgcgccacggccacgcgaccccgggcagccgcgcgcgcgcggcgcaacagcatgccgaccgggccgccggcgcgggccatccatcgcgaccggtggaacaggtcgagcatccagctgcgcggcacgaccgcgggcacggcatcgccatagcggaaccgttccgaccacgcgaccagcggcctgaacagcaactggtcgtacaggacgatcgcgacgctcatcgcgacgatcgcccagcccaccgcggccaggtcccggttcgcgatcgcccgtgcgacataggcgcccacgcccggcaggtcgacgtgcaggtcgccgaccgcgatcgcctccgatgcgaccacgaagaaccagccgcccgacatcgacatcatcgcgttccagacgagaccgggcatcgcgaacggcacctcgaggcgccagaagcgctgccatgcggagagccggaagctgcggcttgtctcgtcgagatcgcgcggcaccgtgcgcagcgactggtagaagctgaacgtcatgttccacgcctggctcgtgaagatcgcgaagatcgccgcacactcggcgcccagcatccgcccggaaacagcgacaggaagaacagcaccgtaaacgacaggtagccgaggatcggcaccgactgcaacacgtcgagcaacggaatcagcacccgctcggccgaccggctcctggccgccgcggtcgcgtagacgagcgcgaaggcaatcgatgcgagtaatgccgcgaacatgcgcgagaccgtacgcagcgtatagccgggcagcgccgcggggacaacgagatggccggggatgcgcgaccgcgagcgggcctgccatctggtgcgccgaaatgccggtcagcatcaggaacccgatgacgatcagcaccgcggcgagatcccgccagcccggcgcgggcagcgtccagcgcccgccgcgcaatacctccgcatggtgctcaaggtgcccccggccgatgatggcagttcatcttccggggcgggcgggacagccgcgttgacctgcgtcaaccgtcccgcaacagccggcccgggtcgggccgacggatgcgggcgcgtcggcacatgagtcgattcatgcggcgggatacgcgttcgcgagcgcctcgacgaacgcatcgaggcacgcgggcgcgagccggttgatgccggccgccgcttcccggccgccgccgtccggaaatgcgcggcaaagccgatcggcaccgtacggtgcggcgaccggcgcgcgcacgctgaccgtgtatcggcctcccgccgcaacggtcagcaccgcatgcgcgcgcgccggctcccgccgcgcgagcaggttggcgaagacgccacggacgcgccgcgcccagcgggcgtcgggcaggatgtagacgtccgcgcccggcagcacgaaggtcgcgcgctgccgttgcgcacgcgcgatatcgcgccgccggttctcggccagacgtcgcgcgaacggcgaccccgcgaaatcaagcggattcgcgaattgccggatcaccgcatacacggcaagcggcgccatgaagagatcgtcgggaagatcgccgtagccgttgtagttgatggattcgccgagcacctgcagccggcgtgcatcggcatccgtcaggctgccggcggcggcgagcgcgccggccacgccgtcgagattgtcgccatacgcgcccaccgccgcccagagccgctgccggccggccagatagcggtcgacaatgacgctcgtgcaggtgtccggcgccgtatcgatatgcgcatgcaggtggggatgagcgggcacgtcgcccgtcacgtggtgatcgaaatagtcgacgtcgacgcctcgcgcgagcagcgcaaccagggcctcgcggttcgcgtcgagcgaaacgtccaggacggtgacggcgtcgccgcggatcgcaggcacgcgcgccagcagtgcaatgtcgcgcttggggcccgtcacgagcaccgactcggccggcgtcacgagccggagctggtgcagcgcgcagatgccgtccgcatcgccgttgaatacgtcgaagcgcgtcatggtgcgccgcgcccgatgccgccggggtgttgcgtgccgtcaggacgcgcgcaacgcgtgcgcggggccgccaccatgcggcccaccgcgatcgagtgaccggtcgggctgcgagcctcgttcatgccgcctgccgcctcgcatgcgcgtccgggccgccgccccactgcgcgacgcatgccgccagcgccggagaaatcgacgcctgcagcggcaccacgggcgccagtgcctgcatggcgtccggcagcgtggccagttcgcgcagcgcgtgcacgcgactctcgtcgagcgtgggcgccgcaagccgcgcgcccgcgaccatgaccggctgcaacagcggcgttccgtcgaggcgctcgccgtccagaccgatgcagtcgccggcgatccgcccgtccgggccgtatcgccggaacacctgcttgcggcccggcagtgtcgccttgccctccgagcgcttgcagcgcgtccggcccgcgtactcgaccagcttgtacgcgcaatcgagatacggcgcgtccgccgacgtgcccatctgcgtgccgatcccgaaaccgtcgatcggcgcgtgctcgcggaccagcgcctgcaaccggtgttcgtcgagattgccgctcgcgaagatcgtggcgtcggtaaggccgccgcggtcgaggatcgctcgaacgttgcgcgcatgcgccgcgagatcgccgctgtcgatccgcacgcccttgatgcggacgccgtcgcgcgcgagccgcggcgcgagttcgaccaccttgtacgccgcgcgctccgtgtcgtacgtgtcgatcagcagcaacgcgttatccggctgcgatcgcgcgaagtgttcgaacgcgagcgcttcgtcgtcgtgcgcctgcacgtacgaatgcgccatcgtgccgtaaacgggaatgccgtagcgcaagccggcaagcagtgtcgccgtcccggaaaaacccgccagatagctggcacgcgccgacagcatcgccgcctccgcaccatgcgtgcgccgcaatgaagtcgaccagcaacctgccgtgcgcgacgcgcgtcgagcgtgcggccttgcttgcggtcagcgtcgcatagtggagcaggttcatcacccggctctcgacgaactgcgcctcgcgaagcggcgccgtgatccgcaggaccggttcgtcggcaaagaacaccgtgccttccggcatcgcatcgaccgtgcccgtaaagcggaatccggcgagcgatgcaagaaagtccgcgcgaaggcgcccggttccggccagttgctccagtgcggcgggcgggaagcacaggcgctccagataatcgagcacgggcgcgagccccgccgccagcaggtatgcgcggtgccctggcaacgcccgcacgaagaattcgaagctcgccgcgtcgttcatgccggcatcgaagccggcctgcatcatcgtcagctcataccaatccgtgagcaacacgtcgtcgacgttcgcctcctgcaaggatccgttcatcatgcccctcccgcgcggcaggtcgcgtcgatgccggccaccatgtcggcacacccagcataggggccgtccggcgcccgaattgcgcgagatcaaggagcggcgttcgaacacgccgccatcgaacaggcacgcgccgggtgccggaaacatcgcaccgggtcgtgaaatcaggatcgtgttcgcgcggcacgaacggttggacggactgcctcccggatgcccgccgacgatgcgcggaacgccgccttgcgggggtcgtgtcgacagcgctggcgatcgcaagcacgcgatgagcgcggtcggcgttcggaaggtgaacgtgtccgatttcttcggatcgacacgggccatgccgccacctgaaacctccagcgccgcttcgcgcgcggccgccacgggcacgccgcgacggaacgcggcgcacgccggatcagtcgcgttgcttctcctcgaaatacggctgacgcgccgccacgaggcgcaattcgtcgagcagcgccgcggccacgcgaagcagatcgtcgagcgagacgataccgaccagttcgccgtcgtcgccgacgaccggcagccggcgcacgccgtgctgacgcatccgcttcgcgagcagccagacgtcgtcgtcgacatccgcgacggcgacgggcgcggacatgatgtcgccgacgaacagcgcgtcggcctccgcgtcggggctgaccacggcgagcacgatgtcccggtcggtcaccatgccgatcggcttgcatcgtccgtcctgttcatggacgacgaccaggtcgccggcatgcgcgtcacgcatcctggcggctgcctcgacgacggtcgtccgtgcgggacacgtcgcgacatcgcgggtacagagcatcgcagcattcatgttcgttctcccggtcggggcgaagcggatcgtcggcgcgtgacgcgatcggttcccgtcgccatgagcgcccgttcgcatccggtgaaaacaacggtaaatccggccgcgcaaccggcaattgatgcaggtcagcgcggtgcgccgtgcggtgttccgcgcaatgccgtggccgtggccgtccggcgcgcggccgtgaagccggcgttgccatcgcggccggggcgatcgcactcggcgaagcgcgacacgatccggcagccgtcgtccgacaagcgcgcgggggcctccacaagcgacgcggtatcgagtcgcacgaggccgcgatcgaccagacagcgaaggtcggcggggtcgccctgctggcatcgcggctcgctggcgagcaccatcaggatcgcgatctcgtggggactcagcagccggtcgccgtcggcgtcgaccggacgattccggtgtggcgcgacgggcggcgtgatgatccggggattcgacgtgtgcgcaaacagggaaggcatgatggaggcccgtatcatgaacgtgaagacgcagacggcacggcgcatgtcggtccccgatcgtgagcgacacgcgcaaacgtttatcttcgctcctgcagcgcaagcggtcttgacgcaggtcagcaagcgcacgcacgcgcccctcactatctgcgattcatctgacgcgatgccatccggagatccgctttgcttgcctgtcaggaacacgtcaacctgatcgtttagcctttggtcgcaggatcggaacgtcacggtagcgtacgtatcttctcgtcggccgctcggactcccgctcacggtcgcacgtcgtccctatcgcgctccgcatcatcccgttttcttccgagagaccgaacgtcgtatccggcttgcatgaaatcaatgcgtcacggacagccggaatccaccatgaatcaccgtcctgaagagatccattcatgaactggtactacgaagtcgaacgcgagctcgcccacatcgaaggatccattcgactgctcgaacagacgcggggctacttccacaagaagacgtcgatcagcgatcccgcatactggcgtgcaagactgcacgccgtcagggcgacggccgagcaggacaagacgctgttgcgccgcgccgacgaaatcctcgcacggctcgatcggttctgatccgctcgcgccgtccgcttgtattcccgatacgtaacgagtcggacgattcgggcaagatcagcgccgcacacgggacgtacctcgatcaatccggcgaagccccgcacggcgcgcaccatcgagtgcggatcggcccgaaccatcgtgcttgatcgccatcaacgcgccgccgcggcatcgctcatggattgcaaggaagcgcgcgggacgattcgcatcgcgaaacaggtagccgaccaagccgaacgaaaccgaagcacgccacgccttgctcatgcatcttggcggcaacccgggaggccgggcgcgctacgtcgcgtcgctcggctccgggatcccctggttcggccagggcctcgcgccgtcgtcaggcctgcgtccggcgcgggccgcaccggtcagtgatcgccgttcacgcacggcaagccgtcgagcgatcgaccggacaaaacgcgcgagtttgcgggacgccagaccgtgaccgatatcgcgcgcggaaatcgcgcaggtcgcgatcggtcgttgccgtgccagcgcctgcatctgtccgaatgccgtcaggtcgccacgcaggcccatcgtgcagaagaatgcggtcgcgtgcagttcgtgcccgtgacgggcgagccaggtcgacaccggcgtcgaggcgcgcccggcccagaccggcgtgccgagcacgaccacgtcgtaggccgacggggacgagaccgtcggccgcaggtccgccgcgcgttggcggatcacgtcggcaagcgaacgcagataaccgatggcccccgcccgccgtcgatcgtcgagctcccgcaaccgttcgcaatccgcgccgagtgccgctgcaagccggcgcgccagccctgccgtcgtttcgctgcgcgagtagaaaacgacgagcatgcgtcgagaagcatccatggtccgctccgtgctcccgcccaggatccgacggtcagtttaggcaccggcggtcgagccgacgctgatgcaggtcaacccgccgccgtgcaatccggcgacagtagacttgtccgaatccccggcggcttctcgtccatgcgcaatgtggtatgacctgattgaacagcaacggcaatggtggcgcacgtgggacgcggccgcgcggttcgcgcgcggtctctggcccggtgtggcgacggcgtgttacgccgatctggtcgagcccctgctcgacctgcatgccggtccgccgcggttcgcgatcgattcgatcgccctggacggccgacgtgtcgacgtcgacgaaacgatcgtcgcgcacacgccattctgctcgctgcgccgctttgctcgcgccggcgcaccgcgcatgattcttctgtgcgtgccgctggccggccatgcggccgtgatgatgcgggaaacggtcgagacgctgctggccgatggtgacgtctgcatcaccgactggatcgatgcgcgcgacgtgccgccggacgcgggtcgattcggcctcgacgaatacgtggcgatgctcgacggcttcatcgatacgctgctggccgatgcacggccccttcacgtcgtcgccgtctgccaggcgacggttccgtcgctcggcgcgcttgcgctgcgcgcgcaacgcggggccgtcccgccgggaagcctgacactgatcggcggcccgctcgatgcgcggatcaacccgggcgcgctcgggatggcggctcgctcgcattccctcgcatggtgtcgcgccacgttgatcgacacggttccgcccggcttcgccggacacgggcgacaggtttttccggcctatctgcaacgcgccgagatctcgctcgcgtatccgcagcactacatgacgctggtcgatcgctatcgacgtgcggtgacggagggcgatgccgacgcactcgcgcaggcgcgccatgcactacgcgaatacctgacgctcctcgacatgcccgccgagtacttcctcgacaccgtcgacatcgtgttccagcgtacctgcctcgcaaacggcacctggttcgtccgaggtcagcgtgtcgaccccgccgcgctgcgcgccatcctgctgctgaccgtcgaaggcacgcacgatgccgtcaccggcgcgggacagacccatgccgcgcaggccatgtgcagcggccttgcaccggacgcccggcagatcgtcgacgtcgaggattgcgaccactacgggctgttcacgggtgagcgctggcgcaccgtcgttcatcccgcgctgcaggccgcgtttgcccgcgccgaacgcggccggccgtgcgcgtgcgcggcgcagcgtgacctgacgtcgtccagctgaaccggcacgatcgcgcgcccgggcgccgcgccgctcaggccggcggcgtttgcgcgccgcgcgctgcctgttccgcggccgccacgcgacgcttgaccccgatgaagctgtcggggctcacggaaaccgagtcgatgccgcaggcgacgaggaaatcgacgaattccggatgatcgctcggcgcctggccgcacagtccgaccttcgccccggcatcgtgcgcggaggcgatcacgcgggcaatcatccacttcaccgcttcgttgcgctcgtcgaacaggccggccagctccgccgagtcgcggtcgaccccgagcgtgagttgggtcaggtcgttgctgccgatcgaaaacccgtcaaagcgctgcgcgaacgcgctcgccagaatgacgttcgacgggatctcgcacatcacgtagatctgcaggccgtcttcgccgcgcttcaggccgttcccggccagcacctcgagcacgcggtccgcctcgtcgggcgtacggcagaacgggatcatcacgatcacgttcctgaaccccatgtcgttgcgcagccgcgcgatcgcccggcattcgagcgcaaacccgtcgaggtagcgcggcgagtagtagcgcgacgcaccacgaaatccgagcatcggattctcttcgtgcggttcgaactgcgcgccgccgacgaggtgcgcgtattcgttcgtcttgaagtcgctcatgcggacgatgaccggtgcgggatggcagaccgccgcgatgcgcgcgaggccgcgcgccagccggtcaacgaaatagtccgccggatcgtcgtagcccgccgtcagcgccgcgatggcgcgcttcgcccgctcgtcctgcaaggcgtcgtagcgggccagcgccatcggatgcaccttgatgtggttgctgatcacgaactccatgcgcgcaagcccgatgccgtcggccggcaggcgccaccacctgaaagccgcgcccgggttcgcgaggttcagcatgacctgcgtgcgggtggtcgccaggtcggccaggtcgatcgcttccacgtcgtattgcgcgatgccttcgtaaacgaagccggcctcgccctccgcgcacgacaccgtcacttcctgctggtcgtgcagcacgttcgtcgcattgccggtgccgacgatcgccggcaaccccagctcgcggctcacgatcgcggcatgcgacgtgcggccccgtggtcggtgatgatcgcggcggcgcgacgcatgaccggcagccagtccggatccgtcgtgcgcgtcacgagcaccgcaccgtcgacgaagcgcgccatgtcgcgcgggctgtcgatcacgcacacgctgccggccgcgatcgcctccccgacactgacgccggtgagcagcttccggccggtctggccgagccggtaggtcttcacggcgctggcttcacgccgggactgcaccgtttcgggacgtgcctgaacaacgaacagttcaccgctgacgccgtccttcgcccactcgatatccatcggctggccatagtgcgtttcgatcgcgcaggcccagtgcgcaagcgccaggatgtcgcgatccgccaggacgaacgcggcacgctcggctttcgacgtcggtacgttgcgggtcggcgcatcctcgtcgcgcgcatagatcagcttccgcgccttgccgccgagcgtcttgccgatgacggggctgcatgcgggatcgccgagcaggggcttgaacacttcatattcgtcgggatcgacgatgccctgcaccacgttctcgcccagcccccatgcggcactgatcagcaccaccttgtcaaagcccgtttccgtgtcgagcgagaacatcacgccggccgcgccgacatccgaacgtaccatccgctgcacgccgatcgacagcgcgacacgcagatgatcgaagcccttttcttcccggtacgcaatcgcgcggtcggtgaacagcgatgcgtagcaccggcggcaggcagcgagcaacgcgcgctcgccgcgcacgttcaggtaggtttcctgctgccccgcgaagctcgcgtcgggaagatcctcggcagtcgcactcgagcgcacggcgacgtcgacgtcgggtcgccccgactggcggcacagttgccgatacgcgtcccgaatcgcatcggcgatgtcgtcgggccagtcgccgtgaaggatcgcctgccggatcgccgcgccggcatcggcgagcggcatcttcctggcgacgaacgcgtcgagcgtgctgccgatggtctgcctcaatccgttcgcatcgatgaaccgccagtaggcatccgcggtcgatgcgaagccgggcggcacgctcacgccctgtgcggacaggttgccgatcagttcgcccagtgatgcattctttccgccgacgctcggcacatcgccgcgccgcaggtcgtcaaaccagacgatcaatgccttcccgtgatccatgatgcgccctccggtcgtcgcagccaggccacgcgcgagtcacgcacgtagccggcaatcgccggcacgggctgccggacacgtccatcctggctccatgccgcgccgccggcgtgacctgcgtcaagaacgggcgccgacacgggcaatgcgctgtccggcgcgcgattcgtctgcgcttgacgtccgtcaacggatcacgtcgctcgtcccgtacgctctcgatcaggggcatatcgatcgcgcctggccaacgacaggactccggacatggattgcatgcatctcgccagatcgtccgccttggcagtcgccgctgcctgggccggtttcgtggtaccgcttcatgcgcaggaaccgggttcgccggccgctgtcacgccgtcatcggccgccgcggcgccgtcggaaacagcggaaagtgagtcgcccgcttccgcgtcgcccccgcaacgtcgccttcggcaagacacgcgcgcaggtcaggcgagagctggagcaggccgagcgggtgggcgaaatcaagcgcatcgaccggttcttcggccgcggcagttgatcgccatcgcgccggcacctgcaacgcgcggcgcgtatcgaaaggacgatcgccgatgcgggtcggcgggtatcgcgcgagtcgtcgcgatcgcggtgatgtgggcttgtaccgtcgcgtcggaacgattttcagtgcgtatctatcacgcactggtccacgtaaattgactgacggtgtgtccgactaacattcgtgtcgaccacgcacgtgcttccccatcacacgccatagcagtagcctgtcgaccaacatctaacgccgctctcgtcatgaaagttagcctccgatagaagggcgaagtggccgcttatgcaaatctgagggtcatcgccgaaagttcctggacctgaaaaagcccggagctgtggggtcgagacggccccctcctccagactctcaagccaatatccagcgatgacgcgctgcagctgcaccctttttgaaatatcgaaatagcatgctgtatcgttatcgcttgaccagcgatgacgcgactacccgatgacgcattctcaatttgcaattccgcgccatcctgcgcgtttcgatggttcccctcgtggaaaaagaacatttccggctgatcgagggggcaaattcaacgctcgaatcgtcctttccgatccgccccgaaccggacacgtgctccgcaggtagatatccaacaacggcaacgtggcacagttttgccaacgtcgacaattgaggagcgtcgattttgccggacaggtaaggaatctgagccgacaatccagaaaatgcagcacagacaagcgcctcgcggcgccgccctgattttccagtcgttcgatccattccggaacgacggacggaggcaaaacggtcatggcgcgataaaagagttcggggcaatccagatccgtccactgagcccgccaaagccggtcgagtgcggccgcgccctcgagccggagcagcgccatgaacgccgcggaccttactgcgcggtcttgatgctcgagcagaatcgtcatgtcgcccgcaaagcgcttcaatccgaactggcgaaccgtattggcaatcgcggtcacgaccgccgatgccgaatcccgcggcgtggaagcaatgacggcatcagcctcttcggacattgctgcggcgttcagtcggcatatgacgtcgaaatcgttatcgagcccggcgagcctgaattcaccgatccgataccaggcaggcccgatccattttgcgatttttccatcaatggatagcgcggcacctgatcgtccaaccatgtccgatattcttcgagccgccctcgatcgcctcctgcgaacgcaacgatacccgctgcaaacaacatccccggcgtggccccttgagtgtcgatgcaatttctgatgcatcgccacgcggtcgcttcgcgcaatgtcagacctctcaagtgaccgagcaggcgcctgtccattcgaacgaaatcgtcgagcgtaaaatcggacaagagcgaagcccgctcacggacgcggtccagatgcacgatttcctcgaggtgttccgtacagaaacgctcggaaaacagttcgttgctatccgacatggcatcaggttaccgtcagtcgacggatttttcgcccgtctcgatgaattctcgataaatagccgacgagtgcatcgaaacacgccggatcgactctgaatacgtagtcgaaactcgaagcaatcgtatgcgaatcatactgataggtgccgctcgcgaacgttcccgcgttcgcgggatcgacgcccggcggagcgaagccgctccgggcgacaacgttcgcccatgtctcgatcgcggcacatatcggggttgcggcctctttggtgaggggctgatcgaactcgatttgtacttcacacccgcgaatcgaatcacgccagtcgagcttctgcacgaacgcaaatggcgcatcaaccgggggcgaggccattcccctgatccacgacaagctcccgctcgaccgcattcgcgtcaggttcttcaatgtgcacgatgctggagcgaatgcccatcgccgccagtagattggtcgcgacccgccactgccatgccggcagatgatccgtggcaacgcgccaacgttgcgtttcgctcactggatcccacgtcgacgacacgaccttcgccgatgcccggcgatgctcgcgagcatcgctcacataaaagccaagatcgatgtacccggcaaataacggcaagggatcggacatgaccagatcggaagtctcgagcgaggtcccttctgcattcttttcgagataagcgacgcccatgccgcgtcccgtgatatcgactcgcatcacgcatacctcgtcaatgattcgatcgatcgaagacatcgagccattcctgcaccccgtgctgccgaaactcccacggcagcaggccgccatccaccgaatcgagcctgaccggtcgcaccagttttgccacaggaccgtacgcagcaacgtaatcgtcgcgagaggagtctccgagctgcggctccggcgtggcctgcaggcacacaccatgtttgagccggcgcaaacgcaccgctgttccggcaatgtgttcctcgatcccggaaattccgccgatccagtcgacctgattctcgctcaggaaggtcaaccagttcgcccgtttcagatagggacgcgcaatggctgcctgatgccgctccgtgaactcggggtcgcgctgccgcaacttgttgccaacgccgaccatgacgctcgcgacatcgaacccaggatatcgctgcatcaacgcggctacccgattgcgggtttccgtatccagatcggggatggaaaattgatgggaaagttgagtccaaatccacaggatcccgaaataaagcgtctgttcgccacgatatcgaattcgcacagccagtctgcgacacgattgccggtcaccagcggatggtcgagcggcaacgtcaaattgaggatcgtgtgcatcgggagcgaccgccgctcggtcgcacgccattgcttgagttcgtcagccgacggttcgacatacggacgatgggcgaagtcgattcgcaggctgctggccgtcgcccccgcatcggcgccattttccatcaagcaatagaatttcttcggaaaagggacggggttttcgcaccaggtcttgacgagactttccgcccgcttgttgatgggtttccagcgtccgtcgccggtgttgtagtgcgtcaggcgatcgcccaatgcttcccgcgcgcgcctgtagaaatcgaagatttcagtaccttcgtcgaactccatcgcccactcgaacaacaggcacggactgatcaaagcgacatcggcgctttcgaagccaagattcattgcgtcttgcatcacgctcctcacggaatgacaaactccggcaccatcccgcctgctccacccaggccgagagacggcaccccattgggaaattccaaaagaggcatgccatacatccccatgcccggaacgggaacctgcttcagcacctcttcctgctgaaccttggttccctttccgcaaccacatttctcagggtccagactcggatcctcaccggagtatggattacgtccgccgttctcctgctcgttgatcgtgttgtaatcctgacgctgcaaattaccattgcctgcacctgggttcgttcgccaggtatccacggttccatcggagcgcgtgaacttcagatcgagcacgctcgtttttccgccgttggttaccgtgaggtccggaaagcgcatctgttcggtcgcccctttcaggaaactgttgagcaggtgctgccaactggaatagttgctgttccagctgccatcggggcgttgccccaaggcttctgggactcgatatccatgtccttgttgccggttgcgtccttgtacttgtcccatgcttcctggaagcatttttccttatccgacatctttggcatatgaaattctcctgcatcaggcggttatcccgcccgtcggcacttccttgatcttgacgaagtcgccaccatcattccccgcatcgcaccagcaaaaatgcggcatagaattccgccctggtcgagcagattcgactggacctcggccggcgtattggtattcgggttattgccattcatcatcatgggatcggaaagcctcgcgacgttgcgcccttcgatcttgacgtcgtagctgtagttcgtaaatttcgcccatccgcgattgacgcccgacacgacgccgcctcccacaccaggctcgtcgccataactgggcttgaactccgactccttcagcgcagcgggaacgccattcgtacgaacggtcttcgatccattgaccagatcgcgcgaaaacgcaacattcgtataaggcaccacaccggcgcccggcgtcttgcaaaagtccggcgccgcgcaggtagcgattccccgcttttcgaatgaacattggtcagcttgttgacgatcactgtagatgccacggtgcctccccgtcatgagaacccatacgctcaagcaggcaggctgcgcgagacagcctggtatccgatgcggaaaaaccagcgaacgccgtcgcggcatcacgatatccgtgagttcatcgtgcgccaacatacacagcattgcggcagacgccgccccgtatcgccccaaatctccgccgggtggctgatatcgagcgggtgcgcaaactggcggccgttacgcagaaacgcgaaatcccattcggcactgcgccaggtctcgccagtcaaatcgccatagcaattgtccacctggatgtcggtggacaagcactgcgagattgcggccgtcagtccgtcgccgcgcgacgcctgatcggcataccacggcatggtttccgtagcgagaccaacggcgcgcaatgcgacacgcgtcgtgttctccgctgacgctcgccccacgtccgcgcgcagaagagcaaaagccgccccctcaccgggaaccatgccgaacggattgtcctggtgcttgagtcggtcggtatcgtcgagccagtgcagataattcatatcgagcggcgagtcgaccccgccaacgatgcaaaaatccgcctctccagccttcaagatgtcgaccgacctggccagacccgcgataaaacccgtatgaccactgcaaaaatcgactcccgctacgtgaaaattgcggcatcgatttgcagatttcgccagcgacggacgcgatatccgcgtgcggcaaaccgggacgctcgggcgggagcgaaagcagcaccggaatgggccttgccggcatcccggcggatgcgtccagaatgtgcccatgacgggccaataaatcgtccagcgcccggcgagccagctccgtcattcgcgatacacaggtcgcatcctcactcagacaatcgagcttcgcgagcgcaatggcaccgcccctgcgggcatacgggtagcgtttgtgtcgcgcgatgcgcgacacgctcgacagtacggcgttgcaagattcggcagcggacaagcccaccgacgtacacgcaccgaatccgctcaccacgatcgggctgtcaaactccatagaacctcccggtatgcagatcccgcttggtatcgacatacgtgacctgtacacgacgagcatcacgcccgcatgccaggacgctgcgccacaccatcaccaatcgactgtcgtccggctcgactatcacgcgatccagttgtgcgtgttgacgaatcgtccggccgcctattgtcgtcaacaggttgaaatgcacacgaggtagccgaaatgtcattttcgccgacggcgtcaggtgggcaagcacgacacgttcgccgcctcttaacggaactgcggtcgccatgcccggcgaggccgagttgaagaatgcgacatcgaaatcgtccggaaccagcggtgcgcgcgtcgtgatccactgttcatcagttgtaccgctgaagcgtgcacgcgccggccacagcggcgggatcgcattcatcccggccggcgcaggtcgatctttccacgatttgatcagatggcgcggatcctcgatatggggcagcttgccgtcgcgcgcgtcgtcccggtccacaaagaatcccatgcccagcggattgtcggagaatccgtcctttgccgcgaactcgttccgccgtaggcgaattcgtaccgtaacggccagcgcgaaaacaattcgggatccgtcatacgcagtccgaataacccagaatcccaacgacgcgcgccgaacaccctgatgactcgatgtatcgacccgatcgagatgccgacatcgagctcacgcaacggttcatcttcgggtgcgtatgccgaaccgttgaccatgatggcgctccccggatgcgcgaacacgatttcggcgtctcgcctcagggtcgagtgccccggctctccgaaatactccggatgcgttttcactggctcttgctgcttcgatagcgacagcgtaccgtcagcgtgcagatcatacgttgccttgacaaccacgacccacaggtgcccaccatgtcggtcgaactgcactgctcgttccgcagcgaacggcgtcacattttgcagttgcaacatgtcgctttcagttcagctcgacaaccgatccacgcaaccggagcgtaccttcagcataggtcgctacattcgtcccgcgaacgatgacgcgtccgtccttgttcaacgtgagacttgcctggccgcacttcagcgtcatcgcttcggccgcttcaacgcatacgtgcgatgcttccgtggtcgcagagatagccggcgtgatggcgtgaacggcggccctcgcctcggcttgatttcttgttccgtgccgacgcagaaggcccatgaggataggttgcgccgggtcaccctgcacgaatgccaataccacttcgcgcccgacgtctgccgcaacgacactcgtggcgcaaatcgcggcaagtggggattggtacgggttatcggggtagtcgatccagacaccatgattcgaatcgaccttggctatggttccgagaaccagctcagccgtccgttgggtcggcggtgcaacactcagtgcggcaatatgttctgcgactcccatctcagcccctaagaattgatatcgacgttatttccgctgattctcacagggcccgaaccatcgatggaaagtgtggccccgctgatcgagatgttcccgttgctctcgagcgtgatgcgcgccttgccaaccttgatctcgagccgatccccggcgctgatcgaccaggtcttgccgacaaccgtatttttcgacagaccgacttcctctgcctgagcgagacctactgccgtgttcatcgctccggcaaccgtgacggtataaccggcgccgattgtcagcgccttggccattccgatcgtctcggccgaagcaagtgcgatcaggagattttgccaaccctcgatcgtttcgttccggttgccgccgaccgtcagtgtctcgttgctgccaacgcgttcggtacgatccacgccgatcgtgatggtctcattgttgtcgaccgtctcggttcggtcatggccgacgtgcaccgtctcatcgtgatcgatgttcttctttcgatcgtttcctacccaatgcgactcgtcgtgctcgacctcgaggcgctgatctttctcagcgtgcaaccagacttcctccgaacccttcttgtcctcgaagcgaatggcgttggccgtgttgacgttgcctgttttggtcgagcgcgtgagaatcccgctctgtgtagcattcgcaggcaatccccatggaggcaggttggcggagttatagacgctcgagatgatcagggtctatccggattaccgtcgaggaaaattacgaccacctcgtcacctatccgcgggatctggatcatcccaaatccgcgaccggcccacggttgcccgacacgtacccagcatgaactgccttgatcgcgcttgcccagccgatcccaatggaattgcaccttcacgcggcccaggttgtccgtgtaaatttcttcccttcgggaccgacgacgacggccgtttgcggaccgatgatcgatgggcgctcgatcgtgaacgccggccgatacggaatcttcttgcggatgcaggtgaaactgcactggtagttcgctgcgccttctccggcctgatagttgttcgttccgctgtgggtgatcgtcgtcagcagaaactgtcgatcctcctgtttggcattgctgtggtcatagtgatcgtcgagttcgaagtattggcatggcgtcagccgccggctcgtgctcgttccgatgaagactttgctgtgtgccgcaagcgcctgcgttctgaagcgcgtcaacgcttctccgcgatcgctgtccgcaaacccatgttcgcccaggtagtcgtagacttcgtacgacggcacttcaccttgattgacttcggttccgcccgaaacaaaccggcgggcgtgcggtgctttgtaatcaaacgtcttcagcccgacactgttggattccagttgccggctcgcctggaacgacgtaacgaccgccagattgtcgagcgcctcgccttttgtgtattgcagctgcggactgcggccgctaatcggcttcgcgctaatcgagttgtccgagatgactagtttgtgaccgtctttcgcgtgctcgaagaagaagaacaggccatcttcttgcatgaggcgctcgacaaattccaagtcggtttcacggtactgcgtgcagtagctgcgattcttcgtcgccttagacaaccggaactcgaacgacgcaatctttccgtagtcccgaaagacttttgaaagaattgcttcggtattctcttcctgaaaaatccggatgtcgcgactgcgcgagagcatccaaagccatggcacgagtgtcgcgctgtagatggtgaagctaccgtcgtggtcgaggtgggtgaagttggctatgtagccgtggaaataccgttcttccgagctcgccagcgcatcggtaagctgtaacgtaatcgtcaccggctgaccgatcaacttcttcagttcaatgttcgagtcttgagaggcgagccgaacgtggaactcaaagttctgagataagccttcggtaccgtgaaaatcgacaagcaccaagtcagatcggcccttcataggcgtctggatggtgaacagccgattgctctgtagcccaaaaacttggaatatctgacagttgcatggcgccctcagaaccctgcatcggagtggcaggatattattcgtcggtggattttaaactgccagacgccgaaaagatcaagttttgcgtttcttgcacctcatatatggggacggatttgtagggaaggtgaatggataacctgttgccccactacgaatacgaggtcggtttactgctccgtggcgcttcggaatttgcgcgacgctatccgaagatcggcgcccgactcgggattgcaaacgggcacggcgatctgcatgtcgaccggatgatccagacgtttgcattgctggccgcgcgtgtcgatgcaaagctcgaggacgcctatccggaattcaccgaatcgctgctggaggtgctgtacccgcagtatctgcgcaccgtgccttcgtgcgcgatcgcgcagtttgatcctacagatctcttcggtcagttgacaacgccgttcacgatgccacgtggcacgctgcttgatgccaacgcggcgccgtaccggtttcaaactatctatgacgtcacgttatccccgttacgagttcactcggtacgctatgccccggctacgcttgtccctgcggctgtccgactcccacccaaggtcactggcatactttcgatcgcgctcgccagcgcgacagcgatggagatcttcgatgaggcaattccgttcggtacagttcgtgttcacctgtccggtgatcgaccgcgcgttgctgcactcaccgatgctatgctgctacgtgctggcgccgcatttgttgaggtcgatcagagcggccggtgggcggaattatctaggataccgatcgaatcggtaggttttggcgagaatgaatgcctattgccgaaagaatcaaccactacatcggatacgtaccaaacgctcatcgagtccttcgcgttccccgaaaaattcgactttgttgacatcgatctaggacgaatgcggcgggccgcacgcacgccagcggcaaagcggctgacgttgcatctcgcaatcctcgacacaccagccgaatccgccgcagcacaggcactgaccgaactcgatgcctcatcctttcggttgtactgcacaccggtggtcaatctgttcaagcgagacgcgattccgatccagttgacaagcgctgatagggcataccccgtcacaccggagccgctggaaaccggctccccgctcgacgtgtactcgatcgatgccgttcatttaggcgatcgcttgcaggctgaacaagagaggagctcgccgtcgaccagtagccacgtacgaacggaagtattgccttaccgggcgttcagccatgctcgctccctgatcccgcgattgcatactgggctgcgtttcgcgatccgtacgcagcaactggaacaacgcgcgcgccactgctgctatcactcgtcggactggagggccattctgctcaactgaaacatccgcaagtcgacgtcgacgtcacggctaccaatggagatttgcccgcccggttgccgatcggtgcacgcgacagcgacctgctgcacgagggcgcggcgttagcatgccccattagattgcttacgcgcccgaccttgccgagcagtctgccgcggggccacgacgcattgtggcggatccttgcgggcatgtcgttgcacccgttcgatctgacgcgaacggggctgaaggcgtttaaagactttctaagactgcacgcgccgcgcgcgagcatcatcgcgcaacggatcatcgatgcgatcaccgacctggaccatcgccccgcgatcagatggatgtcgcccgatggcgcgttcccgtcgttcgtccgcggggtcgagattgtcgtctctctcgatgaagcagcgttgcgcgacgttacgttgcacttgttcgcgcgaatgttggacaggttgtttgccccgtatgctgcgatgaacagctacgtcgaactggttatttgctcctcgcagacggggcgcgaacttcaacgctgtccggcgcgaatcggaacacggccgctgatctagttaatgcagataaccgaccaaaatgcctgcgcccccgccggctatcacgccgacggttgtcccgcccatcaccaagatggcccgcgcatgagcaattgcgttctctgctaaccacaccattgcggggcttgatagcccgagcgcaagctgtgcgggattgatgccgagaagcatggccgtgcctgctttgccgtatccgacgccgacgcctccgtcgagatagaccgtggcccctgaaaatcggacttggagttccttgccgtcaaacgctggcgccatatatatcaagccggcgctgtcaaaggacttgagagaaccggctcctccgacctcatgtccagcaatctttgggatcttgatctcggggattgagaatcgtggcaacttgatcttcgggattcgaagcccaacgccatacccgatcccgatgccgccgtagtagaaatcgaacagttggccgccaggatccgccaagacgattgtgccacccgaagcaacggctagttcgagactgaccccacctgttgcgccggttttgtaagtccagtcgctatgtctgaaaattgacacgtggccctctcaagtcgtttattttctggatggcaggttcatcagcgagaagacaatgaagccgacgccgaagatcagcgccatcaacgtccaattccaaactgcgccgaatcgatcgatcgtggcggatcgcagaggcgcgtcctcctgatacagcacggtcaccttatcgccgactttcatgccgtagatcatccctccctgcggataggagacacgctggcctgctttggtgacaaattcgacctggggatggctcccgcctgcattcaggctgacaacttctccgggtacggcaatcgccgtctggagaaattcatgagtcgaccacgcgacgaaggccgcgattatgagaaaaccgatccccatcacaatgcctaggatagccttgaccatgagccctctcgatttctttcattcgacacgcggagtttgaccgcagcctgtctgcgctggattttagcccatcgccggctatcaaatcggcgcaggcggtttagtcaacctcatgacgccgctttcgacgcatcttgtctgtagtcgtgatgctgatgaaatggcatcgagcgcaccagtggccacgccggatggaattgggcgtagctagcccacgatggccccttgcgcactcccactccagctttgtcgcactattcacgtagcttgtggagacacacattcctccgcgctcgtacgcatcaggtcgataccaaatcgcttcgcctcatgctggcactccgtgcaccatgctccacgaaagatccgcgcacctaacatttcccattcgtgaccggccttacatcgaaaccgatagtttgccttgcttccttcataaacttgggaaacgcaccgtcatcgccgatgagcgattgcgaaaaatgacagtttctccgtcccggggttttggatagattggccgtaccgcatccgcatcgcctcagggacaccatgaacttcgaagccacccccgatcaacgcgctgccgccgccacctatcgcgccgtcgcgctgcgtcacttcgcgtcgtcgccgcgccgcggcttcgactgggcaacctggcgcgcgctgtccgaagcaggtctgtggcgcacgctcgtcgccggccgcgatgcaggcgcggacgcgtcgttgaacgtgttcatcgccgcgttcgaggcgatcgtgaccgcgacgagatccgtcggcttcgcgatggcgctggcgaatcaggcaaccgtgattcgcgcgctgctgctccacggcacaccggcgcagcgcgaccgcctcctgccggccctgacgtccggcgcggtggccgcgaccgccatttccgaaagaggcaccggcaccgaaatccgtgcactgcagagccgcgtcacgctggacggccaggatggccgcctcgacggtcacaagtacaacatcagccacgccccggacgcggcactgatcctcgtcgccgcgagcgccacgcacgacggtcgccccggtacggcgctggttcttctcgatccgcaacgcgccggcgtgacgcgcaccgcgccccaggaaaccctgggcgtcgccgatctgccgatcggcgacatgacgttcgacggtgtttccgtcggcacggacgatttgctttgcactcccaaggacggattgcgcgtgctgatggacattgcgtcgatgaaccgcgcgttgttcggcctgctgtgcgcggacgtggtcgggccgttcctcgacgacgcactcgcgtacgtcggcgaacgcggcgcgctcggcgtgacgctcgacaagcatcagcatgtccagcggcggctcgtcgacattcatgtcggtgcggagcgctcgcgctggatggcactcgccgcactcgaccagttgagggcgggcgacccgtccgcgctcgccagttgctcgattgcgaaactgggcggcgcccgcgacctgacccaggccgcgctgcacctgctcgcgatctacggcagcgacggttatcgccgcggcccgctcgcgaccttcgttgccgacgcactcgccatgggaacggcgggcggcaccgaagagatgcacgcgcgcaacatcttcagccagatgcagcgacgcgcgactgcctcgcacatgcacgcggcctgagtgctcatttttcgtttctcatcccgaaggagtctgccttgaccatccagcccggcctccgtgcccgtgccacgcaccgcgtcgatacgatttcgcttgcagatcaatggggcggcgaagcgcacgcccttgccagcccgatcatgatcatcttcatcgagcagacctgcatgcaggcaaccgatcacctgctcggcgccgacctgatgacggtcggctacaacttcgagatcaagcatctcgctccgacgccgcccgactgggaagtcacggtcgacgccgagctgatctccgtggaaggccggatgatgacctacaaggtgtcggttcgcgatgcggccggcgtcgtcggcgaaggcatccatacacgctgcgcggtcggtcgcgacagttttcacgagcggcttgccgagcgccgcgaccgcgcaccggtcgcgcaatgagcatcactggaggagacaccccgatgcgctcgacgccgctgcacgatttgcgcctgccgctgatcgcatcgccgatgctgatcgccagctaccccgagatggtgctggcgcagtgcaagagcgggatcgtcggcgcctttccgcgctcaatgcgcgaccgagcgcgcagctcggcgactggatcgatcgcatcgacgaggaactggccgcgcaccgtgccgcccgtccggatgcgtgcgtggggccgtacgcggtcaatcacatctgccatcagaccaacacgcggctcgaagcggacttgcggatctgcatcgaccggcgcacgccgatcctgatcacgagcctgcgcgcgccgccgcgcgaaatcgtcgaagccgtgcacgcctacggcggtgtcgtgctgcacgacgtcacgaccgtacgacacgcggagaaagcgctcgaggccggtgtcgacggcctgatcctggtcgcggccggagcgggcggccatgccggcacgttgtcgccgttcgcgctggtgtcggaggtgcgccgcattcatgacggcttcatcgcgttgtccggcgcgatcgccaccggcgcggccatcgcggcagcgcttgcactaggtgccgactgcgcgtacatgggcacccgcttcctcgcgtctcacgaagccaacgtggcgcagcgctacaaggacacgatcgtcgaggccacggccgccgacatcgtctacaccgatgcgttcagcggcgtgcacggcaactatctgcgccagagcatcgaggccgcgggcatggacgtccgcaacctgccccgcagcgagcacgcacacctcgatttctcgcccgaatccggcgcgcgccagtggcgcgacatctggggcgccggtcagggcgtgggttcgatggacacggtgctgagcgtcgagcagatcgtcgcgcagctcgagatcgagtacggcgtcgcactcgaacgcgtgcgtcacgagtccgcccgcatcggccggcacgcacccgcgcactgaccgggcacccgccttctttcgctacctccacggtaccgtcatgaccctcaccgccaccgacttgcccgctctcgatccggtcgcgctgcaacgcgcgcagatcgatgcaatcgaccaggaactgctcgcgctgatcgcgcgcaggatgcagcacgccgccgcgatcggccagttcaaggcgctcgacggccggacgatccgccagccggcccgggaaacggaaatcgtcgcggggctgtgcgcccggccgcacgggctgctgcaggcgcgccacgtcgcggcgatctggcacacgctgttccgcgtcagccgcgagttgcagcgggtgccgtcggtcgcgttcctcggcccgcccggcacctttaccgagaccgcgatgcagcgctacttcggcgccccgatccgtccacatgcgtgcgacacgctcgaagcgacattcgccgcactggcggccgcgaacgtcgaccatgcggtggtgccgatcgagaattcgaccgaaggcaccgtcacgcgcgcgatcgacctgctggccgacgcgaccgctccagtggtcggcgagatcgtgctgccggtcgcgcactgcctgctgagcgcatccggcacgctcgaaggcgtcgactgcgtgctcggtcatcagcaggcgctggcacagtgccgtgcatggctcgatgcgcatgcgccgcaattgcgccgcgtgcctgtcgcgagcaacgccgcggccgcccgcgaagcagcgagcatgacggattgcgcggcgatcgccggcgaacgggcggccgaccagtacggactgcgtatcgtggcgaacgcgatccaggacgagcccggcaatcgcacgcgctttctcgtcctcggcgggccgccagcagagccgacaggccatgaccgcaccagtcttctgctgcagctcgacgatacgatcggcgcgctcgcaggcgtgttcgatgcattggcgcgccaccgaatctcggtgctgtggctcgacgcgcgtcccggccgcgccgccggatgggcgtaccgcttcttcgtcgacatcgacggccaccaggacgacgcgcatgtccgtgccgccctcggcgacatcaggtcgatcgccgccgacctgcgaatcctcggttcctacccgcgcgcgccgttcgtcgatgccggcgccgttgccgagccgagcgcgacatgagtgccgcgtccgccgataccgccgtcgcgcgccgggtgcgggccatctgtgacggccacgacgatcgcctgctggtcctgctcggggtcgtgccgccgtcgctgcgtcgcgacaccggcgcatggctgcgtgcattgcgcgcggactacgaggacgaactggagttgctgacgcatgtgcagcgcgtggccacgccggacgtcgacgacgacgcgcgggccgcgctgcttcgccggctcggcagactgcggctgccgacggcgttggtcgtcgatacgtccgcgacggcctacggccgctggtgcacgcggaacggcgccaccgcgcacggctggcggctgctggaaaccgcgcgtggcgcggcgcccgtcggcggcgtactcgtgccctggcgcgactgcctcgcggcacccgcgacctcgcgccgcgtgctcgccgatttcggccaggcgtgggccggcatcgatacgagcgtcgccatgctgaccgacgcgctgcttgcgaacgacgtgcaggtcgggggcatcgcgctgggcgatctgctcgcgcaacccggtgccgcgcccgtatcgcctgcaaggatgaccggcgtcctggaccgcctcgccaatacggtgcgcctgcgccgtatcacggcggcgacgcgccggacgcattcgctgcggagccggctgtgacggcagcgcaccatccgcgcatcgcgttgatcggcatgcccggtgcgggcaagacgacgatcggcgcggcgcttgcggcggcactcgaccgcccgttcgcggattccgaccgggagatggagcagcgcttcggcgccccgcttgccatgctgtttccgctgccgacgttccgcgcccgcgaagccggcgtcatcgatgcgctgtcgcaacgcgacacgctgatcctcgccaccggcggcggcgcggtgctgcgcgacgacacgcgcgcgcgcctcaaggcgcgctgccacgtgatctacctggtcagcgacatcgacgcgctgtaccggcgcaccgggcgcgatcccgtgcgcccgctcctgaacgtgcccgatccgcgcgccgtgctggccgagttgcagcggacgcgcgatccgctgtatcgggcctgcgcgcatcgcctgctcgacacgcgcggcgcgtcgatcgacgaaatcgtcgcggcggccctcgccgaatccgcgtccgcctgacggtcgcgcccatgcgcgcggcttcccgctcccggttcccttcccgccccgtcacgggcgctccccactgccatttctgacagttgctcgttgtttgagaatatctaaagatatatttttagatagtctgaattcgtcaaccggactcgtggaaaccgatcatgtccaagtttcttgtctcgactcgaagatggggtccgatcgctacggcagccgtgacggcggccgtcatgaccggttgtgccccgttcggccagcagccggacaaacagaagatcaccccggtcgaacagctcgacccgggcctcgcgcttcacgcggccaagggtcaggccgacgtggacgcgcaatggtggcgcaccttcggcgatccgcagctcgaccgcgtgctggccgacgcgctcgcgggcgcgccgtcgctgaaggcccagcgcgcccgggtcgacgaggcgctcgcgcaagccgacgtcagcgcggcggattccctgccgctgctcggcgcagcggtcagcgcgacgccgacgcggctgccgcgcagctacaccacgccgcccccgccgcaggccactggcaagtcaacgcgcaggcgctgctgaatgcgtcgttcgatctcgacgttgccggccgcctgcgcgcgctgacccgcgccgcgaccctgcgcgccggcgagcagcagtcgctcgagcgcgcggcaaccgtgtcgttgcaggccgcgctcgtcgaaacgtacctgcagctcgcgctcgagctgcaactgctcgacatcgcgaacgatacgctgcgtcagcacgattacctgctgcgcctcacccgccagcgtgaagcggcgggactcgacatgccggtcgcggtcgcgcgtgccggcgagccgctgccgctcgcgcaggccgatgtcgagcggcagcgcgcggccgtcgcgctgctgcgccaccggctcgcggcgctcgtcgggcgcgggcccggttatgcggacacgctcacgccgtcaccgcgcgtgctgcatgccgtcgcgccgttgcccgcgacgctcccggccgcgctcgtcgggcgccggcccgacatcctggccgcccgctatcgcgtcgaggccgcgtcggccgacatcgacgcggcccgcgcggcgttctatccggacatcaacctgatggcgttcgccggcgtgcagagtttcggctttcgcgcgctgcttcacggcagcagcggcacgttcggcgccggccccgcgatcacgctgccgatcttcgaaggcggcaggctgcgagccggcctgcgcgcacagaccgacgcgtacaacgccgccgtcgccgactacgacgacaccgtcgtcaacgcgctcgcccaggtcagcgactcgctcgtgcagctcgacgcgctggccaggcagcgcgacctgaatcgcgatgcgctggcacgcgcgcagcagacctacgacatcgagacgcggcgctaccagaaaggcatttccggctacctggacgtgctgctggccgaaacccggctgcttgaagaccgccggtcggtcgctcgcgccgatacctcacttgccgtcgagcacgtccggctgatcgccgcgctcggtggcgcaacgaaccccggagcccaacaatgaatcgcaccgacaccccgccggccgccgcgccggccgccgcgagcgcggcgtcgccccgcccgccgaacaggcgctgcgcaccacgcggcgccgctatttccgctggttcttcatcgcgctcgccctggccgcgctggccggcggctactggtgggtcacgtcgcgcggcaccgagacgaccgacgacgcctacgtgacgggcgatgtcgtgcaggtatcgccgcaggtggcgggcacggtcgacacgatcatggtgcagaacgccgaatgggtccgtgccggcgatccgctgttccgcgtcgatccgaccgatgcgaagctcgcgctcgacgacgccgtcgcacagctcgcccatgcggtgcgcgagtaccgcaccgcgcatgccgacacggcgcgcgaggcggcgcagatcctccagcgcaaggccgagctgtcgaaggcctccgacgacctgcaagcgacggctcggcctcgcgcaggacggcggcgtatcgcgcgaggacatccgccacgcgcgcgacgcgatgaccagtgcgtccgccgcgctggacgcgcagcaggccgcgtacgacgcatcgcgtgcgcgcgtcgacggcacgtcgatcgactcgaatccgctggtgcgcgccgcggccgcgcgggtgcgcagtgcggcgctcgcactgcgccgcaccgaaatccgcgcgccgctggcggggctcgtgacacgccgtgtcgtgcaggtcgggcaacacgtcacgcccggcgcgccggccatggcgctcgtgccgctcgaccatgtgtgggtcgaggccaacttcaaggaatcgcagctgcgcggcatgcacgccgggcaggccgtcgagcttcgctcggacctgtatggctccgacgtcgtgttccacggccgcatcgaaggcgtcgaggcgggcacgggttcggcattcgcgtcggtgcccgcgcagaatgcgaccggcaactggatcaaggtcgtgcagcgcgtacccgtgcgggtcgcgctcgatcccggcgaattgcgcgcgcacccgctgcgcatcggcctgtcgatgaacgcatcggtcgtgctcggcgacggcgcgcccggcaccgcatcggcctccgtgcgccccgcgccggccgccgcccggcgcccgatcgacgcgacgtcgatcttcgatgacgatgcatcgtccggcgacgccctcgtcaacgacacgatccgcgcgaacgacggcgttgccgtgcgccgcgcgccgggagcctgagcatggcgcccgtcgctcggggtgcggcgccgaaactgccgctggagccgctgcagggcccggctctcgtgctcgtcgcgatcgcgatcagcgtcgccaacttcatgcagacgctcgacctgacgatcgccaacgtcgcggtaccgaccatcgccggcgatctcggcgtcgcgcccgacatgggcacctggatgctgacgtcgttcgcgacgccgctcgcgatcacgctgccgctgaccggctggctcgcgcagcgcttcggccaggtgcggctgttccgggtctcggtcgtgctgttcgtcctgacctcgatcctgtgcggcctcgcaccgaatttcgaatcgctgctgctgttccgcgcgctgcagggcgcggcctccgggccgatcaccgcgctctcgcaggcgctgctgctggccgtgtttccggccgcgcgccgcaacgtcgcgctgtcggtctggcagaccaccacgttcgtcgcgcccgtgctcggcccgatcgccggcggctggatcaccgacaacctctcgtggccttacatcttctacgtcaacgtgccgacgggggcgctggtcctgctcgtgctgacccgcttcctcggccggcgcgacaacccgacccgccaccttcccgtcgatttcgtcggcctgctgctgctcgccgccgcattcggctcgctgcaactgatgctcgaccgcggccagaacctcgactggttcgcggcggtcgagatccgcgcgctcgccgtgctctgcgtcgtgtcgttcgtcgcgctggtcctctgggagctgaccgacgcgcatccgatcgtcgacctgcggctgttcgcggatcgcggcttcaccgcgggaacgatcgcggtgacggtcggcttcggcgtctattacggcgcgctcgtgctggtgccgctctggttgcagaccgagcagggctacacggcaacctgggccggcatcgccaccgcgccgctcggcatcgcgggcatcgtgatcgcgccgttgatcgggcgcatccaggggcgcaccgacccgcgccacctcgcgaccgtggcgctggtcggctggggcgcggcgtcgttctggcgcatgggcttcaataccgacgtgacgctcgacgacatcgcggccaactcgctgctgatgggcgcggccaccgcgttttcatcaccccgctcgtgtcgctgtcgatcgccgggttgccgcgcgaaaggctgccggcggcgtcgggcgtgcagaatgcgctgcgccggatcggcaccagcgtcgccacctccgtcgcgccgacctatttcgagcggcgctcgcgcgttcacaacacatacctcgtcgatcgcatcacgccgttcgatccggccgccggcgactggctcgcccggctcgaacatgcgggcatgtcaccggccggcgcgctcgcgtcggtcagccgctcgatcgacgtgcaagcccacatgctcgcgctcaacgatttctcgttcggttgcctgctgctgttcggcgcgaccctgctgaccgtctggtccatccgctaccggcgtccgtgacgccgatcaaccggccccttccgatgaacgcccccgacctccaaaacgtcgtcgcacccgacatcgccccggcccgcacggcccggctcatctgtttcggcgtctttctcggcgcgctgaccttcggcctcctgctgcccgtcgtgccgctgtacgtgcacgacacgctcggcttcggcacgctcgtcgtcggcacggcggtcggcgcgcaattcctcgccaccgtgctcacgcggagcatcgcgggccgccgcgccgatcatcgtggcgcgaagcgcacgatgtgcgcgggctcgtgtcgtgcgtcgtcgcgggcggcgtctacgtcgcgagcgccacggcgccggccggcccgggcgcacgtctcgcgctgctggttgccgcgcggctgctgtccggctcggcgaaagccagctcgtcaccggggcgctcgcgtggggcatcggcacgctcggcgcgacccgctcgggccgcgtgctctcgtggacgggcatggccctctacggcgcgatcgcgctcggcgcgccatgcggaatggcgctcgcgcggcgggctggcggcggtggccggcgccacgatcgtcctgcccatcgcactcgcgctcgtcgcttcgctgcccgccgtcgcgccgcagccgggcctgcgggtgccgctgtcccgcgtgctgcgaatcatcgcgcggcccggatgcagcctcgcgctgcagggcgtcggtttcgcggcgatcggcgcgttcgtgacgctgctgttccaggcgcgcggatgggaaggcgcgggcctcgcgctcagttgcttcggcggcgccttcgtcctcgtccgcgtcctgttcggccatctgcccgaccggttcggcggttatccggtcgcgctcgccgcgctcgcggtcgaggcgatcggccagcttctcctgtgggcggcgccggtttccggcgtcgcgctcgtcggcgcgaccgtgtccggcctcggctgttcgctggtctttcccgcgctcggtgtcgccaccctccggcacgtgccggcgcaggcacgcggcaccgccctcggcggcttcacggcgttccaggacgtcgcctatgcgtgcaccggcccgctcgcgggctgggtcgtcgcgcgtaccgactacccgtccgccttcgccgtcggcgcgtgtgccgcattcgccggcgccctgctgacagcgtggctgatgcacgccgaccggtcgcccccgtgagccccggcggacggcgggcgcatgccctgccgtccgccgcccgtatccgacaccctcgcggcgcccgcgcggcgccatcctgcagtccttcacgcttctacaaggtaccgatcatggaataccgaaccctcggcggaaccggcttcaaggtccccgttctgagtctcggcaccgcgacgttcggcggcggcaacgcattcttcagggaatggggcagcacggacgccaccggcgcgcgcgagctcgtcgacatcgcgctcgacgccggcatctcgatgttcgacagcgcggacgtctattccgacggactcgccgaagagttgctcggccaggcgatcgccggccggcgcgatcgcgtgatcgtgtcgacgaagggcacgttccggctcggcgaaggcccgaatgacgtcgggtcgtcgcgccatcatctcgccaatgccattcacggcagcctcaagcggctcggcaccgactacatcgacgtgtaccagctgcatggattcgatgcccagacacgcgtcgaggaaaccctgcgcacgctcgacgatttcgtgcgcgccggcaagatccgcgtgatcggctgctcgaacttctccggctggcacctgatgaagtcgctcgcggccgccgatcgcgacgggctcacgcggcatgccgtgcaccaggtctactattcgctgatcggccgcgactacgaaacggagctgatgccgctcgcgctcgaccagcaggtgtccgcgatcgtctggagcccgctcggatggggcggctgaccggcctgatcggacggggccgaccgttgccggagacgagccggctgcacaagaccgccaacgagggccgcccgtcacggatgccctgctgcaccacgtcgtcgatgcgctcgacgagatcgccgccgaaaccggcaagtcggtcgcgcaggtcgcactcaactggttgctgcggcggcccaccgtcgcgaacgtgatcatcggcgcccgcaacgccacgcaactgcgcgagaacgcgcaggcggccagcgggccttgacacccgaccaggtgaagcggctcgatgccgccagtacgacgcaactgccctacccgtactggcaccagcgcggcttcgagcgcaacccggcaccggtctaatacggtgcctgcgcgtgcggcatcggcggcgaccgatgcgacggtaccgcacgcgtcgccgcggcctgcatgcgcgcggcgagcggcgacgcgccgaccagccagtccagctcgacgggcaacggcggcagcgcgggcgacgcgtgcgcggtcagcgcatcgtagccgaacacccagtccggctcggtcgggccatgcatgaaggtattcgcggcggacgcgatgcacttcgccgagtcgcgcgacccggcactgcgcataggtcgagaacgcactcgccgcgttcgacgagccgatgagcgcacgcagcaggatcgtcgcgtcctcgagcgccatggccgcgccctgcgacatgaacgggcgcatcggatgacaggcgtcaccgatcagcacgacgcgctcgttgccgaactcgaactgcggcgaacgttcgaacaacgcccacttcatgaccgactcgcgtggcgcgcgtgccagcatgtgacgcacggccggatgaaaatccgcgaaaatcgcctgcatctcgtcgacgtcgcccggcatcgacgaagcctgcgtgggccactcggcctgcggtgtcatcgcggcgaaatagaattcgcggcgcgcgcgatcgagccagtacgacagcacgaatttccggtcgccccaccacttggtcagatcctcgaccgcgagttcgcccagcagcgcgcgcggatacgccccgcgaaacgcgacctgcccggagaattccggcgcctcgaatccgcgcagcgcctcgcgcacgcgcgagcgcaggccgtctgccccgatcaccagatcggccgtttcgctcgaaccgtcctcgaacgtcagcctgatcgcgtcgcccgccgggtcgaggccggcgagacgcttgccgcgatcgtcccgggcgccaccgcccccaacagcgcggcatgcaggtcgccgcgcttgagcgtcacgaacgtcgcgccgaagcggccgatcgcgtgttcgccgagcggcagccgatacagcagctcaccgtcggccgcctggcggttggcgaacgcatcgggttcctggcccgcccacagggcctggcgatgcacgccgagcagccgcatcacccgcatcaggttcgggctcaggtgaatgccggcgcccacgggcaaacgccggcgcctgctcgaacaggcgcacgtcatggccgatccgttgcagcatcgcgccgagcgcgcacccgccgatacccgcgccacgatcgcgatgcgcgccgccgaagtcgtcggtcatccctgctc

SEQ ID NO: 6 - DNA, 48589 bp, Burkholderia cepacia strain SSG
tgctgccgatgcccgccgccagcatcatcacgcccatgatgctcttcgcgttgatcttgcgccgttgcgcgtcatccagactccgactgggttaccggccagttgcgtaagcttggccgatgcgcgcatggagccccaatttattgacgatggtggtttcttgttgaagcatgattctcggtcgggtcggtcgggaccgccggcggcgcgcgccggcggtgctgtctaaaacgaaaaaggaaatcagtgcgactcggtgcgcggttgcggttccggcggaatcggcgcgttggccgcagccggtttccgtcggcggcggcggtgtgcggccgacacctcgtggacgcccttcgcgccgccggacagcgccttgtcgacgagcttgtcgagcggcacggtgcggtagcagacggcccgcacgagcatcggcaggttcacgcccgccagcacgcgcacgttgtcgagcttcgcaagctggccggcgatgttcgctcgcgccgtacatgtcggtcagcacgaccacgccgttctcttccggagccgcgcgagctcgcgtgcgcgaacgccatcacctgggccggatcgctgtccgccatcacgtcgatacagccgatgcgggcgggcacgccgccatagatgtgcgcgatgcagtcccgcagcgcggtggcgagcggggcgtgcgcgatgatcaggatcccggccatgtcagatcgctcccggccgcccctggcgggccgatacccgcggcggggcaatgagcgtagcgagtgtgggaaacatttcatggtcagccttgcaacagtttcggcccgaccgccgggcctttggtgcgcgatcgcggcaccgggcaagcgggcattgtagcaggccggtcgagctgctccggcgacggggacctgcgcggccgccgccggggttgcgcgggagacggcctacgcggccgcacgctccagcgcgtcgatgaacatcgcggcgacgtcgaagcccgtctgctccatgatctcgcggaagcacgtcgggctcgtgacgttcacctcggtcagccagtcgccgatcgcatcgaggccgaccagcaacagcccgcgcgccgcagctgggccgagcgtgtcggcgatctcgcgatcgcgcgcggtcagcggctgcgcgacccgagcccgcccgccgcgagatgccgcgcacctcgctgccctgcggaatccgcgcgagcgaatacggcaccggctcgcccgcgatcagcaggatgcgtttgtcgccggccttgatctcgggaatgaacttctggatcatcagcgagcgcgtgccgtcatggccgagcatctcgatgatcgcaccgaggttcatgccgtcggccttcacgcggaacacgcccatcccgcccatccgtcgagcggcttcacgatcacgtcgccgtgctcggcgtggaaggcgcgcaggcgcgccacgcgcgtgacgagcgtcggcgcgacgaattgcggaaactcgccgatcgcgagcttttccgagtgatcgcgaatcgactgcggcttgttgaatacgcgcgcgcccgcccgttcggcaagctcgagcatccacgtggccgttacgtattccatgtcgaacggcggatccttgcatcagcaccgcgccgaacgacgcagcgcgcgactcgtgagcggccgcctcgtaccacggttcgcggtgcaggtcggccgtgtcgccgacgatcgtcacgcgctgcacgtccgcgacaccgctccccgtccatgcgagctggtgcggctggcacgcgtacaccgcatgcccgcgccgcgcggcctcggccatcatcgcgtaggtcgaatccttgtagatcttgaagcgctcgagcgggtcggcgataaagagaatgtccatgaggtcctgtacttggcgaaggtccgttatacctggatggcttcggggtcggtcttttccagttcgatcgacgacgcgatcagcgacagccgcgcgacgacgccgtacatgtaaaacggttcggcggcgcggcgcccgcttcgcgccggcatccggcagcgcggtgtgctcgaagccgagcggcacgtagtgcatgccgggcgcgttcaggttctggtcgcgctcgcggccggcgtgcgtgcggtagaagccgccgaccacgtagcggtcgatcgtatatctaacgggctcggccacttcgtcgccgacgcgctcgaacgtatacacgccttcctgcacgatcacgtcgcgcaccgcgaggcggccttcgactcggccatctgcgcgcgctcggccttcgacatccggccgatctcggccgcgtcgtgcggtcatcacgccgcgccccgccgtgcccgcgtcggccttcacgacgacgtacggcttctcgctgatcccgtattcgcggtacttgcgcgcgatcttcttcagcacgccgtcgatcgcgtcggcgagcgcctgctcgccttcatgcgcctgccagtcgacgccttccacgtgcgcgaaatacggattcaccatccacggatcgacgccgaccatcttcgcgaacttcttcgcgacgtcgtcgtagcacgaagtgcgtcgacttgcggcgcacggcccagcccgcgtgcagcggcggcagcaggtactgctcgtgcaggttttccagcacggccgggatgccggccgacaggtcgttgttcagcaggatcgagcacgggtcgaaattcttcaggccgaggcggcgctgcgaacgctcgagcggttcgagcacgatcttctggccgtcggccagcgtgatcggcgtcatgtcggtgatgctcgggtcgagcgagccgaagcgcacgttcaggccggcctggcgcatgatcgtcgcgaggcgcgcgacgttttcgaggtagaacgcgttgcgggtcggcagctcgggaatcacgagcaggttcttcgcgtccgggcagatcttctcgatcgcggccatcgcggcctgcacggcgagcggcagcacttcggacggcaggttgttgaacgcgccgggaaacaggttcgcgtcgacgggcggcttgaagccggcattgcgcaggtccaccgaacaatagaacggcggggtgtgttcctgccattcgagcctgaaccagcgttcgatcgcaggcgtcgcgtcgaggatcttctgctcgagttcgagcagcggaccgttcaacgccgtaacgaggtggggaaccatgaatcactcgcgagcgggagaatgaagattgtagagcaattgccttgcccatttggggattgttcccggcttcacaaggatatgcaggaagttttcggctattgacccgatagagtgaagggttatccgctacgtcagtgcgtgacaggagaaaaaagcccgccgggtaggcgagccgaagtcgctgcgctcattcggggcgggcgccgtcgtcgcgacggcccgccgttgattcgtgtgacttattccacgtgctcgccgtgcaggatcacgtcgagaccttcgcgctcttcctcttcggtcacgcgcaggcccatcgtcaggtcgatcagcttcagcagcacgaagctcagcacgccgctgtagaccagcgtgatcagcgcccttcgcctgcaacagcaggctgccgtcggcgccgccgatgtcctgaccgcgaacacacccgtcagcagcgcgccgagaatcccgccgatgccgtgcacgccgaacgcgtcgagcgaatcgtcgtagccgagcttcgacttgagccaggtcgccgaccagaagcagacgacgccggcggcgtgccgatcaccagtgcacccgccacgccgacgaaaccggcagccggcgtgatcgccacgagacccgcgaccgcgcccgacacgatgccgagcaccgacggcttgcccttcgcgatccactcggcaaacatccagccgagcgccgcgcaggcggtcgccacttgcgtggtcagcatcgcgaagccggcacggccgtcagcggcgaccgcggagcccgcgttgaagccgaaccagccatcgagccgccgatcatcgtcagcacgaggttgtgcggcgccatcgattcgcggccgtagccgacgcgcttgccgagcacgaggcacgacacgaggcccgcgataccggcgttgatgtgcaccaccgtgccgcccgcgaagtcgagcacgccgtcggccgacagccagccggtcggctcccacaccatgtgcgcgaccggcacgtagacgatcagcgaccagagcgtcatgaacacgagcatcgccgagaacttcatgcgatcggcgaacgcgccgcagatcagcgccggcgtgatgatcgcgaacgtcatctggtagacgaagtagaccgattccggaatcgtcgtcgcgagatggctgacggtcagcgtcgtcgccttgtcgcccttgatgtagttcatgccgtgcaggaatgcgcgcgacaggccgccgatgaagccgttgcccggcgtgaacgcgaggctgtagccgaccaccgtccacacaccgtgatcaccgcggtgatcgcgaagctctgcatcacggtcgcgagcacgttcttcttgcggaccatgcccgcgtagaacagcgcgaggcccggatcgtcatgaacagcacgagcgcggtcgacgtcagcatccacgcggtgtcgcccgcgctgatcttcgacgaatcgaccgagaacggtgcggtcggcgcagccggtgcggccggcgcggacgcggcggcggccgatgcgtcggcgcccgaagccggtgcggcggcggcggccggtgcagatgcatcggttgcagccggtgccgaagcggccggcgcggcggcagccgggcgtcggaagccgttgcggcgggcgcggacgcagcggcggcggacgccgcgtcgtcggcgagcgcggagccgacgcctgccgcgatcagcgagccggccatcagcagggacatcagaagtttgcgcatcttgggtttcctcttgtcgcttgtcttgtctgttctgttacagcgcgtctgcgcccgtctccccggtgcgaatccggatcacctgttcgatcgccgtgacgaagatcttgccgtcgccgatcttgccggtgcgcgcggcccgctcgatcgcctcgaccgcctggtcgacgagatcgtcggacaccgctgcctcgatcttcatcttcggcaggaaatcgaccacgtattcggcgccgcgatacagctcggtgtgccttctggcggccgaaccctttacctcggtcaccgtgattcccgagacgccaagcgccgacagcgcctcgcgcgcttgaacggcttgatgattgcggtaatgagtttcatgaagtcctctcgctgagttgtcccgtcgaattggttggaatgttgtaacggactctcctcagcaactcgcatgccatgtcgattcgagcaccgtttcgaagggcttcatcaaggggttgcatcccgcgatgtaaggtgcgcaagcccggccgaatggccaacgcgggccgctttgctggcgcggcgaaaggaacgttgctagagtgcacgcacgtcccgggtcaccgggccattcacccatgccggcgccatgcccggaattcgcgccccggcgcaccatttccggtcatgcgtgcatcatgggcacgtacgcaactgaagatgcacatttttgtgcaaggaaggggaatcacatgaagcaacccagcgacgttttcaacgatctgcagtcgcgcgtcagcgatctgctgaaaaactcgccggccaaggacgtcgagcgcaacgtgaaggccatgctgtcgcaaggcttttcgaaactcgacctcgtcacgcgcgaggaattcgacacgcaggcccaggtgctcgcccgcacccgcgtgcgcctcgaggaactcgagcgcgtcgccgaactcgagcagaagctcgccgcgccgcaagcctgacgccccacccggcctcaaggtccgggcgcgggcccctcgtgcggcccgcgcccgccagcgaaaacctgaaaccctgaagtcgcgctaccgcgcttcgtcgtaagtcgttctccgcagcaccccgctcttcgctgtccctcgctcttcgctgcccctcgctcttcgctgcccctcgctcttcgcagcacccgttcttcgcagcacccgttcttcgcagcacccgttcttcgcagcaccccgttcttcgcagtccctcgttcttttcccgcgccacgccggcaagcgcgcaccgattcctccgattcccgcggcatgcggcgaacggccgtcgcccgtccgtcttgtttaggagcctcgccatgtcgctcgccgtggtgcgcagtcgcgcgccggcctccggccgtgcgccggacgtcaccgtcgaagtccatctcgccaacgggctgccgtcgttctcgatcgtcggcctgcccgatctcgagtccgcgaaagccgcgagcgcgtgcgtgccgcgctgcagaactgcggtttcgaattccccgtgcgccgcatcaccgtcaacctcgcgccggccgacctgccgaaggagtcgggtcggttcgacctgccgatcgcgctcggcatcctcgccgcgaacggccagatcccggccgacgcgctggccggccgcgaattcgcgggcgaactgtcgctgaccggcgcgctgcggcgatgcgcggcgcgttcgcgatggcgtgcggggtcgcgcgggactggcaggtcgcggaaagcggagcggcttccggttcgggcaacggtgatcaacgggccgcccccgatctggccgccgtcgcgtcaaacgctcccgagctgtacctgccgctcgccagcgccgccgaggcggcgctcgtgccggcgtcaccgtgttcggtgcaccggacctgcccgcactgtgcgcccacctcgccggggcgcccgacgcccggctcgcaccggtcgcggcgccatgcctcgacggcctgccggtgccggccgccccgatctcgccgacgtggtcggccagcgcggtgcccgccgcgcgcaagtcgcggccgcgggcggccatcacatgctgatgatcgggccgccgggcgccggcaagtcgatgctggccgcacggctgccgggcctcctgccgccgctgaccgacgacgaggcgctgacgtcggcggcgctcctgtccgcgagccgcctcggcttcaccggcacagtggcgccggcggcgttccgtgccccgcatcattcgtcgagcgccgccgcgctggtcggcggccgcaacccgccgcaaccgggcgaaatcacgctcgcccatctcggcgtgctgtttctcgacgaactcggaattcgaccggcacgtgctcgaaatgctgcgcgagccgctggaagccggccgcatcacgatctcgcgcgcggcgcagcaggccgacttcccggccgcatgccagctgatcgccgcgatgaatccctgcccgtgcggctggcacggcgatccgtccggccgctgccgctgcacgccggacgtcgccgcccgctgcgcaagctgtcggggccgctcgtcgatcgcatcgacatccagatcgacctgcccgcgctgtcgccggccgaactcgcgtcgcgcgcgacggcgcccggcgagccgagtgccgcggtggccgcacgggtcgcgcacgcgcgtgcgctgcaactcgaccggcagggcaagacgaatcacatgctgagcggccgagaaaccgacgatctctgccggccgaccgacgaaggcgagcggctgctgcgcgaggccggcgagcgtttcggctggtcggcgcgcgcgtatttccgtgtgctgaaggtcgcacggacgatcgccgacctggccggcgccccgctgccgacggccgcgcagatcgccgggcgatccgctaccggcgcgcgctcacggcgctgtgagcgtcatcggaggacaaaatccggctgtcaagacttgacttatgcacaattccacgaatccggccccggatcggggctcggcaggacctttgcagcacggaatccgtatctcattgttttgattgattttcacaaaacgcaagcgagcgaccaaatgggccggaaggccgtcccgcgcggcttggcaggaaattcgggaaacttttcaacaaagttatccacatgcgctgtggatagccgaaaaaacctcgcaaaatccggcgactagcgccgaaagttgcgaacgaactttcagttgtcacgacgtgccccggcgccctcgccgaggccgtcagtcgagcgaacgacccgaaaaactggtcgagctgctcctgggcaagcggcccgtcggcaatcacgacggcctggtacgcatgccggccgcgcgcgacaagccgtgcgacgatcgtcttgcgcgcgcgatcgcgccggcggccgcgcccgcgatgcgcagctcgagcccgttcaccgcgccgccggccgcaagcggcaccggcaccgcagccgtctgcggcgcgccgtcgaggttgcgcgacagcccggtgcgcaggaactcgagcgccgcgcggcggtgtcgtcgctgtcgtccggcagcgtcagcgtgccgaccgcgaacaccgcgccgtccacgtgcgcggcctgcatccgcatcggcatcgacgcgccgccgatcgccaccggctgctgctcgacggtcggcttcgccggcaggtcgacggtgtagccggcgtcgttgtgcagcgtgcgccagtcatacgacggtgagcacgcggccagcgcgacgctcatgcacgcgagcgcggcgaagtgtcgcagcggacgaaaagggggcgcaacgaatcggtgacttccttcggcatggcgtggagcgggcaggcaaaacgggcattatccgccgaacgtgaattccgggatgcgtggccgccgtcggtgcacatccgcattcgcgctaaaatgagcgccgaatttcgatgtcctttgcttcgatccgcgtcatcgaccgactccgagagcaccagatgaacaccacgcctcccgcccggcgcagcgccggaccgtccgctacatcgtcgccgccgccgtcgtcgcggcgatcgccgtggccggcttcttcgcgttcaacggcaagtccaccgtgccggacgccacgttcacgctgctgtcgggccagaaggtctcgaccgcaggcgacctgaaaggcaaggtctatctcgtgaacttctgggcgacgagctgcgcgacctgcatgcaggaaatgccgcagatggtcgatacctataatcgcttcaagggtcaggggctggagttcgtcgccgtcgcgatgaactacgatccgccgatgtacgtcgcgaactatgcgcagacgcgccagttgccgttcaaggtcgcgctcgacgacggcagcgtcgcgaagcagttcggcaacgtgcagctcacgccgacgaccttcgtcgtcgacaaggacggcaagatcctgaagcgctacgtcggcgcaccgcagttcgcggagctcgacgcactgctcaagaaggcactcgacagcaacgcggcctgagcgccgcccgatccgactcgaagggccgcgcgccgcgccacctccgcacgacggaccgcacgaccgggcaacccggtttcgcggtccgttcgctttcagcgctcggtttcgcctttcgccgacagcccgtagcgtttcatcttctcgtacagcgtcgccttgccgacatgcagccggtcggccgtcgcggcaaccgcgccgcccgtctggttcagcgcctcggcgatcaccgcgcgctcgaattgctcgatgcgctccttcagcgtctgctcgttgtcggcgtcgccgccgttcgcgcccgtctcctgcggcatgtcggccacgccgagcacgaagcggtcggccgcgttgcgcagctcgcgcacgttgccgggccaatcgcgctgcatcaggctcgcgcgctgccggtcggtcagcaccggcgccggccgcgcgtaacgcacggccgcatcgagcatgaagtgctcgaacagcggcacgatgtcctcgcggcgctcggcaagcggcggcagcgcgatcgtcacgacgttgagccggtacagcaggtcgcgccggaacgtgccggccgcgacgagctcgctcatgtcgcccttcgcggccgcgacgacgcggcaattcacgcggatcggctggttcgagccgagccgctccagcacgccgtcctgcagcacacgcagcagcttcacctgcagcgcgagcgtatgctttcgatttcatcgaggaacaaggtgccgccggatgcgtactcgagcttgccgacccggcgcttcgcggcgccggtgaacgcgccgggctcgtagccgaacatctccgattcgaacatcggctcgggcagcgcgccgcagttcaccgcgatgaacggcttgtcgcgacgcggcgacagctcgtgcaggctgcgcgcgatcagctccttgccggcacccgtgtcgccgttgatcagcaccgacgcgtcggtcggcgcgacgttcgcgatcagcttgcgcacctgctcgatcgcggggcttcggccgatgatgcgcggcgcgaccacgttctgcccggcgagctcgcgccgcgcgcgtggttctcgagcacgagctcgcgcgctcgagcgcacggcgcaccgtctcgatcaggcgctcggccgcgaacggttttcgatgaagtcgtacgcgccgtcgcgcatcgcctgcacggccatcgagatgtcgccgtgccccgtgacgaaatcacgggcacgtcgggcacgcgctcgcggcactgcgcgagcacgtcgagcccgctcgcgccgggcagccggatgtcgctgacgatcgcgccggcggtatccgcgacgatcgccttctcggctgcctcggccgactcgaagccggcgacgtcgaaccccgccagctgaaggctctgcacgcttgcccggcgaacgagcgcatcgtcttcgatatagatcacttgcaggcggttggccatcgtactcacttgctcctgacgggccgcgcggcgcgcgcggcggcgttgataccgatcgtgcaccgatcgggcgggcggcatggcgcgcctagcgcgagcccgccggctcggacacaggtcggatgatgcgtgcgggcgcgccgcagcgtcaagacgaacagcgcgccgcccgacggcgcgttgcgcgcagtcagcgccccgcccgcgtcgctcgcgatcgacgacggatcgcgagccgagcgagcccgcgccccatttccttggtcgtgaagaacggctcgaacaggcgcggcagcaggtcgggcgcaatgccgcagccgttgtcgcgcacctcgatcgcgagcgtcgccgccgacaccccgatcgtcacctcgatcgccggcgccgccacgcctgcgaccgcgtcgagcgcgttgccgagcaggttgatcagcacctgttcgaggcgcaggtcctcgcagcgcgcgacgagctcgggatagtcgcgcgccaggtcgagcggcgcatcgtgcgcgggcgacacggtcgcatcctgcaacgtcagcgtgagcgcgacgccgcgcaggcgctcgtcgagcaacgacagcacgctgcgcagcgcgcgcacgaccagcgcctgctcgttgcgcggcttcgcgcggccgacgaacagcttcgagcggttcgtgatcttgcccatccgctccgtgagcgcggcgatcgcctcgaggttctcgcgcgggccgcctgctcgccgcgatcgagcagcacacgcgtgttgtccgagaaactgcgcagcgccgcgagcggctggttcagttcgtgcgtgatgccggccgccatctggccaagcgcggcgagcttgctcgcctggatcagttcgtcgtgcgcggcgcgcagttcctgttccgcgcggatcggtcgccgacctccttctgcagttgctcgttcgcttccgacaggtcggccgtgcgctcttcgacgcgccggttcagctccgcgtacgcctgctgcaacagcgcggcggccgcgaatcatttcgcgcacgcgcgcggcgcatcgccagtagaacgcgagcagcgcgaccgacacaagccgaagcccgtgacgatcgtcgcgttgcgcgcgtcggcgtcgacgggcgcgatcggcgccagcgtgacggcagcccgcgcccgccgcgtgtcgcgccgagcgcggcgcgcgcatgctgttcggcgatccgcacgatcgatcgacagcccgagcccgctgcccgacgacgtgactgcctgcggcgtgccgcgatagaaacgctcccacacgtcggtgcgttcggcttccgggaccggggccgtcgtcggcgacttcgagcacgggcgtcgtgccgtcgagccgcgcggacacgtcgacacgcgcgcgtcgcccgcatagcggatcgcgttgtcgacgaggttgttcagcagcacgcgcagcgtgtcggcattgcccgacgtcatcacgcgtcgacacgatcgcgccgagatcgatccggtgcgcgtcggcgacgcgcgtgcggtccgataccaccgaccggcatcgcggcgagatcgacgggtgccgacgcggaagcggccgcctggccgttcatcgcatcgaggatagcgggcggaagcggtattcgatcccgacggctggcgggtgcgcgcgttgctggcggcgacacgcggccgtcgcgccgatcacgtaggtgacggtcgcgtgcgcgtgttcgttgggtcttcgagatgcggttgacgcgtgcggtgttcggtgcgcttcggctcggcgagcaggtccgttgcagcgttcggcggctgccgagcgatcggcatcgatcgacggtcgagcggctcgacgcgttcgggtgcggtcgacgcgaccgcggcgttgcgctgcctgcgacgccgcgccgatgatcgtgcacgcagcgtgcacgccgcggcgagcgcggcggcaagccgacgcgagagcaggcggcgcgtcacggtcgcttccggcgatgcggatcgcgattgttcatggcctgccgcgtgccctggccgccgcgggccgcaccgcgggcgatgccgccgctgcccttcgctcgtcggacgccggccgtctcggtcggcggacttcgccgccgcccttagcgcctggcgcagctcgttgcgtcgagttccttctcccagccgacgacgacggtcgccgacgccgttgccgacgatgttggtcagcgcggcattcgctcgtcgaagcggtcgttccgagatctgcttccatgcccgcagcggtcgtcggcactcgtcgagctcgcgcggcgcgagcagcccgcgccggcacgccgcgcgacgcgtcagcatcgcgccgcgagcgtgagcatgccgcatgcgcgtcaccgatccggtcgccgcgcgcgaacgcgtggcatcgcgtcatgcgctgccgatccggttgccgacgccgcgcaccgtgcggatcacgtcgtggccgacttcttgcgcaggttgtggatgcatgcacggcgttctcgagatttcctcgctgcagctgcagcggctctcgacgagctcgtgccgcgcccgggtcgcgcatcttctcgtgcagcagcacgaactccttcggcgacagtgtgacttcgtcgtcgccgagccagacgaggtgacggggtcgagccgcagcgggccgatcgcgagggtcggcgcgcggcccgcgtggcggcggttgaccgcgcggatgcgggcgagcagttcgtcgagttcgaacggcttgacgagataatcgtccgcgccgctgtcgaggcccgcgatgcggtcgggcacgccgtcgcgcgcggtgatgatgatcgcgggcaggttttcgtcgcggcggcgcagcgcggcgagcaccgacaggccgtcgcggttcggcagcccgagatcgagcagcagcaggccgtagccggtcgcgcgcaacgcgagcgacgcggcgtcgccgtccttcacccagtcgaccgcgaagccttcctgtttgaggccctgttcgagcccgctgccgatcagcggatcgtcctcgacgagcagtacgcgcatggattcgtgtctcttcaacggggcgccatggcgcccggggttccatgataagcgcgcgtgccttagcgggagcttaaacacgggcgcgcggccggcttgcgcgcgtgcccggtgcggcaccgtgccgctgcggcgcgaccttcaggtttgcttaatcttacggtccgtaatctggggccgtcgcgttcaacggagcgcggcgtcacatcgaagaagaggaccgagatcatgaaacacctgacgagaatcctggcggttgcgctcgccgtgctgcccgccgccgtttatgcggaatataccgggccgtccacgctgaccacgacgaccgtgaaggaactgctcgcgaacggcaaggacgatcagcacgtgcagttgcaggggcgcatcgtcaagcatgtcggcggcgaggattacgaattcgccgatgcgacgggcacgatccgcgtcgagatcgaccacaagctgtgggcggccggccagcccgtcagcgaccggaacgaagtgaaggtgaccggcgaattcgagcgcaaatggtcgggcagcgtgaaggtcgacgccgaccacgtcgaagtgctgcgctgaccggcgcaccggtgtatctggggccggtgataccatggacgaccggttcccgttcacaccaagatggccgccaatttcgacgaactcgcgtcccggatccgggcgcaattttccgagctgagcccgcaattccaggcgggcgcggccttcctgctcgatcatcccgacgaagtctccacgtcgtcgatgcgcaaggtcgcacagcgcgcgcaggtgcagcccgcgtcgctcgtgcggctcgcgcagcaattcggcttcccggctggaacgaactgcgcgacctgtgtgtcgcgcgcgtgcgcacgcgccccgagccgctcacgcagcgggcgcgctcgctcgtgcggcccgatgcgaaggcgtcgctcgcgcacgacctgctcgccgcgcaacaacacaacctgtcggccaccgccgcgcagaacgagcacgcgctcgccgatgccgcgaaactcatccgcaaggcgtcgcacgtgcatgtcgcggggtttcgctcgtgctacccggttgcattcggcttcgtgtacggctaccggctgttccgcccgaccgtgtcgctgctcaacggcgtcgccgggtcgctcgaaatggagctgcggacgatcgcgaagcagagcgtgaccgtcgtcgtcagcttcgcgccgtattcggcggaagcgacgcgcgtcgcgcaggccgcgaaggcgcagggcagccggatcgtcgcgatcaccgacagcgcggtgtcgccgatcgcactgcacgcggacgcacaactgatcttcacgcacgacagcccgtcgttcttcccgtcgctggtggccgcgcacgtggccgaagcgctggtcgcacagttgctggcgctcgaaggcagcgatgcgatcgccgcgctcgagcgcacggaagcggagctgcatgcgaagggcgcttacgtcgtctgacgcggtgcgtgcgggttcaaccttcttcatttccgattcaaccggactcgaccgatgacgttcacatacgaggtgaccgacgcggggacgtgaacgttcgcaagcagatcgtcgcgccgctcgtccgattcaacgaaagccaggcgggcccgaacgacttccgtgcgctggccgtggtcgtgaccgacgtcgaaggcacggtggtcggcggcttgtggggcagcacggcgtacggctggctgcatgtcgacctgctcgtggtgcccgaggccgcgcgcggccagggtgcaggcacgcgcatcatggatctggccgaggcggaagccgtcgcgcgcggatgccacggcgtgtggctcgacacgttcgacttccaggcgcggccgttctacgagaaacgcggctatgtccgcttcggcgaactgccggattatccggccgggcacacgcgcattttcctgacgaagcggcttgcgggctgagcatcgccgcatggagcggcccggttgacgcggtcgccggccgtcgcctaggatagcggccagcgatgcaggtcgcttccgggtccgcggaaagggttgaacccacctgtcgcagcaaatccagtcttcctcctgtcctttgtgctggcggtattgcggaccttcggccatgactgcacgaggattcgcatgaaaaagctgcctcccggggccaatcccgatcatctgaaaaagcaggccaaggcattgttgcgcctgtaccggcagggcgacgccgacgccgtcgcgcgctttgtccgctttctccctgccgctgccaaccgcacgcacgacgaagcgctcgcgctcgggctccggctgcacgatgcgcagtcgtgcattgcgcgcgagtacggtttcgcgtcatgggccgatctcggcgcgttcgtcgaaacgcatgcgctcgccgggcaacagcggtcggcgttgatccggcgctggctcgacctggcgtacggcgccgacgtgacgggcggtttcgatgcggcccggccacgtgtcgccgcgcaactgctgctcgaccggcccgatctcgttgcaagcgatccgaccgtcgcgtgcgcggccggcgacctcgatgccgtgaaggcggcgctggccgccgatcccggatggatcgcgcgcgccggcggcgtgctgaagctgccgccgctggttgccgtcacgcattcgcggctcgggcagattcccgggttcgccgtccggctgcgcgcctgcgcgcgtcatctgctcgatgccggcgccggtccgaaccagcggatcggtaaccggtttccgccggcgtcgcttgccgcgcccgacgaagcggggccgctgtcggcgctgtacggtgccgcgggcgtcaatcgcgatccggttctgaccgcgatgctgctggaagccggcgccgacccgaacgacggcgaatcgctctatcactcggtggaaaatccggcctgtacgcgcctgctgctcgaacacggcgcgcgggtgggcgggaccaatgcgttgcgtcgcgcattcgacatgcgcgatgcggacgcgctcgaactgctgctcgcgcatggcggcgacccgaacgagccgcccggcgagggctggcgcagacctggggcgcaccgttgttgcgggcgatcggcgtgcgctgctcggcgcgccacgtcgccgcgctgctggcggccggcgccgatccccgcgcgcggaccccggcgggcgtcagtgcgtaccggctggcgatgcagaccgggctgtccgaggtcgccgcgttgttgcgtgcggcgggcgcggaagaggcgctcgacgccgaggacgcattcgtggcggcctgcgcgcgcgccgacgccgacgatgcgcgacgcatccaggcacggcatcccgaactgccgggcgcgctgcccggcgagcggctgcggctgctgccggatgccgccgcgtggggatcgggcgacgcggtgaaggtcatggtcgaactgggctggccgatcgcggcgcggggcggcgactgggacgcgagcgcgctgaatcacgcggtgtttcgcggcgatgcgggcttgctggcgttcctcctcgagcacggcgcgagctggcgtgacatgcacgggttcggcagcgacgcgctcggcacattgtcctgggcatccgtcaacgaaccggagcatgtcggagcagccgactgggaggcttgcgcgcgggtgctgctcgcgcacggtgtgccgcaagccgcgcgggacccgtcgaatccggacggcgtactgatcgacggtcgcgcgatgcgtttctccgaagccgtcaccgacgtgttgctcggcatcgacggcgggccaccggcggcacggtaagcggctatcggttggcaacggatgggcggcggcggcccgctcgttgtcggttgccgattgcgggttgccggctcccggctcccgactcccgactcccgactcacgactcccagcttccggcttccggcttccggcgtgcagtcggcgcatcggtttttcctgtcgcgcgacgacatttcggtgaacgctgaaacgtcgcgtgcacgatcggcgtaagctcggccgtcaactttctcctggagcccgcgatgacccgttccgatcttcaagcccgccaagccgaagccttccgcgccctgcatgcacgcgccggcgccttcatcatcccgaacccgtgggacgccggtaccgcgcgcctgctcgcgatggccggcttcgaggcgctcgcgaccacgagcgccggctacgcctttcgaaaggccggcccgactatgcgatcgaccgcgacgagatgctcgatcacatcgccgagatcgccgccgcgggcggcctgcccgtgagcgccgacctcgagaacggcttcggcgatgcgcccgccacggtggccgagacgatccggctcgcggccgaggccggcgcggtcggcgggtcgatcgaggatgcgacgggccgcgccgacgcgccgatctatgcgcacgaagcggcggtcgagcgcatcgcggcggccgtcgacgcggcgcgtgcgctgccgtttccgttcacgctgaccgcgcgctgcgaaaactacctgcacggccgccacgacctcgccgacacgatcgcgcggctcgtcgcctatcgcgacgcgggcgccgacgtgctgtatgcgccgggcatcaccgatgcggacgacatcgcggcggtgacgcgggcggtcggcgcacccgtgaacgtcgtgatggggctgcagggcggattgctgagcgtcgacgcactggcggcgctcggcgtgaagcgcgtgagtgtcggcggcgcactggcgcgggccgcgctcggcgcgttcctgcgcgccgcgaaggagatggcgcaggacggcacgtttacgttcacgcaagcggccgttcccgggcgcgatatcaaccgctggtttgcgtcgccggataattcaccggttttgttcggtgaatgagtgtaaataaatcgtgggatcgttcccaatcgaaaagttgattgataataatcaatcgatttcacgtcagaattaaacgtcggtgacgacgaaaaatacatcgtctattctccgcatttcgcccgttcgaccgggtccggcgcgcaagccgcgccggatcgggcggccgggcatccgccgggcgtgtcgatggcgcgcattgttgcattttcccgatcatgacatttttgaaaagggagttgccggccggtttttgattgataatctgcggcacgttcgaatgaacagttggtgggctgccgggaatatcgatatataaaaatgctgagagagcgatgacgatccgagaaaatcaacgcgtcaggtttcgcgtcggcgatgtcgtgacgctgaagacgggcgggccgcgcatgaccgtgacctatgccgggccggtcgtattcgacgacggcgactggctgatctgccagtggttcgacgaacacggcgaattccggcaggaaatgttccctcacgacaccgtggtgccggagccgcgcgcgatttcggccgggcgtgtccgcatgcgcatgcagtcgcatcgctaccggtcggctgcctgacattcacctgacatcgcgaggcggccgcacgcggcgcccgcgccgcgacatttcacgccggcccgaaacatgcggcggtgcactgcgtcgatactgtctgcatgaacctgaccgatcccatcgcagcggttacgcaccgcgatccctatccctactatgcggcgctcgtcgacgggccgccgctcgcgttcgacgccacgctcggcctgtgggtcgcgagccgcgcggccgccgtgacggccgtgctcggccatccggcctgccgcgtacgcccgctggacgcgcccgtgccgcccgcgttgcgcggcacgacggccggcgcgctgttcggcgagctggtgcgcatgaacgacggcgcgttgcggcacgacgtgccgaagcaggcgctgcgcgcggcgttcgcgccgatcgacacggctgcgttgcgcgaccgtgccatgcagctcgccgcgcggcgctgccgccgccgggcgatgccggcgcgctgaacacgtggtgcatgacggtgcccgtctgcgcggtcgcggatctgctgggcttcgacgaggcgcagctcgacgcgatcgcggcgcaggtggtcgacttcgtcgcggcgctgtcgccgctgtccgatgccgaggcgctggcccgcgcgagcgacgccgcgcgacagttgctcgaccggatgacggtgcgcgtcgcgcagacgcatgcgcacgacggcacgctcgtcgccgccgtgcagcaggcggcccgtgcggcgggctggcaggcaagcggcgcgctggtcgcgaacctcgtcgggctgttgtcgcagacgtgcgaggcgaccgccgcctggctcggcaatgcactggtggcgtggaacgggggcgcggaagcgggcttggaagcgggcttagaagcgggcttagaagcgggcttagaagcgggcgcgggcgccgcgtgcgtcgtgccggacgatgccgcgctcgacgcgttcgttgccgaagtcgggcgcttcgattcaccggtgcagaacacgcgccgcttcgtcgcatcgcgcacgacgatcgaaggcgtgaccatcgaagccggcgacgcgatcctcgtcgtgctcgccgcggcgaatcgcgacccggccgtgcatcgcgatccgcaccggctgatgcccggccgcgcggccgggccgaatttcggcttcggcacggggccgcacggctgcccgggcgagcggatcgcacgggcggtgacagcgggggcgttcggggcgtggctgcgtgcgggcggcgggccgcggcacgacgggctggcgtggcattaccgcgcgtcgaccaacgtcaggatgccgaagttcgacgcggcagggtgatcgggaaagagggacttaacggcagccttgcttttccgcccattgctcctgggcggcgacacggcgctgcacgcgttcgacgagaccggttgaaaaggtccgcatgctgatgccgcgacgcttggcgaggatcgtctgcgcgacatcggtgcgggggttcggctggcaggcccagtacagcgtcatcagccagccgatgccggtccacccgaacagcgcgttgaacatcgcgaccgtcagcttgtcgtgccggccacgccggtcggcaatgaccgccggcagaaaatagatcgcgatcgcggccaccgaaccggccacttgaatcaggactgcgttctgcatgttgctgctccatccgaactgcaatggagccgattgtcgcgctttttccgttcgcgtgcaggccgcgctcagacaattgattgttgcggttttaatgatgatcagccggcttcggtgtccgccggctgcatttcgttgctcagcgcgaaaccttcgtcgcgccagcccgtcacgccgccgatcatcagcttgaccggccggccgaggtgcgcgagccggatcgccgcgcgcgcggcgccgttgcagtgcgggcccgcgcagtagacgacgaacagcgtgccggccggatagccggcgagcttgctctcgatgatcttgcggtgcggcaggttgcgcgcgccgggcacgtggccggcggcgaaccggtcggggccgcgcacgtcgagcagcacgaaatcgggcgcacccgatgcgagcgcgtcgtgcacgtcccagcaatcggtctcgaagcgcagcgacgcctcgaaatgcgcgagggcggcggggctgtcggcagcggggacgtcggtgacgtaggacatggtcgagttctcctgaaggttgcgcggaacgcagtggaatgaagggcagtatcgcggttcgtcgaccgtcgcggcagtggcgcgatcgacaagttccggtaacatcgcgccatgcataatcatctcgtcgtcgcgctcgcctacgatcgcctctgcaccttcgaattcggctgcgtggtcgaactgttcgcgctcgaacgccccgagctcggggtcgactggtatcgcttcgcggtctgcgcgagcgagccggggcccgtgcgcgcggcgggcggcatcacggtcgccgcgccgtatcggctcgcgatgctcgatcgcgccgataccatcgtgattcccggctggcgtgatccggacgaaccgccgccggagccgttgctgaagaagctgcgggccgcgcatcgccgtggcgcgcggctttgctcgatctgctcgggcgtgttcgtgctggccgcggccggcgtgctcgacggcctcacggtgacgacccactggcgctatgcggagaaactgcaggcgcgttatcccgcgctgcgcgtgaatcccgatgcgctttacgtcgacgaagggcaggttgtcacgtcggccggatcggcggcggggctcgacatgctgctgcatctcgtgcgccgcgatcacggcggtgcgatcgcgaaccgggtcgcgcagcgccgtgctgccgccgcatcgcgacggcggccaggcgcagttcgtgccgcgcccggtcgcgccgggcggtaccgaccggctcgcgaagctgatcgactggatgcgcgcgcacgcggccgagccgcacacgctcgcgtcgctcgccgcgcaggccgcgatgagcacgcgcacgctgcagcggcagttcgcggacgcgacggggatgtcgccgctcgcatggctgatccgcgaacgcgtgaacgtggcgaaggacatgctcgaagcgcatcccgcgctgtcgctcgcgcaggtggcggcgcgtgcggggttcggttcagaggagtcgctgcggcggcatttccggcgtgtcgcggcgacgagcccggccgcgtaccggcgcgggatggatcgcggcgtaagatcgcaggacgcttgagcgccgcgctgttgcgcggtggctttcgtacccggcggcgcaccgcctgaccggggcattccggacgaaagcgcaacaaaccaacaacatgacactcagagagaacctcggattcggcttcatgcgcgacgacgcgcacgtctattgccacgatggcccgctgcgggaccgcgccggcaatctcatcgaaggcatcgcgatcgacagcttccggccgttgtcccggtatctggcgacggacggcgtgcgtgcctatgcgtgcactttcacgtggttgcgcttcaccgtgctcgacgtcgacgccgcgacgtttcgcctgctggacgagtcgcatgccgtcgacgcgaaccatgtctattttcagaaccggaaacttgccggcgcatcgcctgcgcgctttcggctgctgagcgaatcatgggggcatgacgaccgttacctgtatcactacggcaagcgcatgcgcggcgcggatcccgcgacgctacgttgggtcggcgcgtatctggtcgacgcacagcgcgtctggtacggcgggcgggcactggaaggcgccgatgcggcgagctttgtcagcgcggatgaagtggcgcaggatcaggcgaccgaccgcgcgcgtccctaccgttacggccatgcggatgatcccggcccgcgcgagcaatgggaacgcaactggtcgccgttcttcgccgcgcgccccgaattgcaggggtactggtggcacgcgctgatcgggcagcccgtggcggacgtatcgacgcgggaactcggcggcggataccgggtggtcggcgatcaggtgtacctgcacgacctgccgctgctcgaaccggatgcggggacggtccgatggctcggcgattcattcatcgcggaccgctcgcggctctattcgtattcggagtaccacaagggctttcttcgcggagggccgcttccgggcgatcctgcgcagtggcggcatcttggcgggccgtggtatcaggccggcgaccattgctatcggcagcaatggcgcggccatgcggaggccgcgaaggtcgacggcaagacgttcgagatcctgaacgatacctatgcgaaggatcgcaatggcgtgctgtgcatgctggtacgcaagcgcggcatcgatcccgcacgaatcgaagtcgtcggcgacgaccatctgcgggaggggaccggctgttctatttcggcaaggaagtgaaggccaggttcgacgccccgacggccgaaccggtcggtcacggctttctgcgcgacgggcaggggcgattgctgcactacaaccagccgtatcggcgcggcgtcgacggagcgacgctcacgttcctgtccgagtatttcgcacgggaccgcgcgcgggcctacgtctattgcaacggcgccgaactcgtgccgctgcccggcgtcgatccggccgcctttcatctggagcaacccgatatcggcacggacggcagtcgtcgctacgtgtatcaggcatggctggctgcgtggcgcgcgtgtgacaggtcgccgatgcccgactacgtgccgccggactacgtggcgcccgaagcgggagcacgggccgatgccggaccggcgcccgaatcggtgtcggcgaacgggttcctgcacgcgtcgcccgccgggccggacgccgcccggcgggcgtgcgtgatcgaatgggcgcgcgacgagacgggcgaaccgcgactcgtcgtggccggcgacggattctgcgacatctgggatctggcgcagcggcaagtggtcgcgtcgtttgcgctgcctcgtccgttcgtgcccgacgagacggaggcgacggcaatggaccgactgcgcaacgtgccggtgagcgcgtcggccgatgcgtcgttgtcgacgctgattgtcgcgtactgggacaacacggcactttaccgggtcgatgccgcgagcggtgcagcggacgcgtgctggcgggcagacagccgttatgacgatccggaacgggttcatctgtcgcccgacgcgcgcgaagcgtgggtgcgcatccgcaaccggctctatcgcgtgccgctcgccggcgacggcacgctcgacgtgctcgattacgatctggccgaccagcgtttccaggacgctccgttcgcggtgagcgccagccggcatcgccgcgcattcgcgcgggacgcggcgctgacggtgcgcacggatggcgcgaccgattgcgacatacccggtgcggacaacggctttccatgcgcgttttcggacgacggcacgcgcgtgctggcgcgcgacgcgaaattcgtgttgcgcgagttcgacgtcgacagcggcaagcgcctcgcgttgcatcgtggcggctggtgcgagcgcaagtggttcaagagccaggccggctggatcggcgggcgccccgtgttcgtcggcctgccgatgggcgggcagggcgaggtcgacatctgggatgtgctcgacaaccggctgctgtttcgcatcgaggccgccgcacgcgtgcccgagccggacgcgggctgacaccgtcgcgacgctgcgaccggtcgcgggaagaacgccgggcgattccgaagccgatgcgagcagccgacgcgatcgcgccgtgatacggcgcatgcatcctccaacccggcgacgacggtgcagcgcaggcggccggtgaccggagcaaccggccgcgtgtactgaacggccgcgtgccaccgcggccggtgcaggctcaccgcggaatggtgtcgcgcgccttctgcttgatgcacgcgatccggtacacgccatcctcgacttcgacaccgtgcgtgtcgtgcgtgaagcccgggaagcgcaggtcgtactgctcgagcgccttcaggtagccgagcagcgggccgtcggccggccctgcgttctcgccgggcatcagcagcggaatgccgggcggatagggcacgacgcccgtcgcgacggtgcggccttccatctccgacagctccagcatctcgatgtcgttgtgcacgagatgctcgaacgcctcggccgggctgtaatcgggcttcggcagcgtcgagaagccgcgcgacatcatctcggtcgtcttcaggtcgctcatcgcgctgaacatcaggtcgcacaggtcgcgcaggccgagcttgccgtagcgttccggatagcgcgcgacgagttcgggcagcacctgttcgagcggcgcgttcgcgtcgtagtcgcgcttgaagtcgagcagcgtgttgacgagcgtgccccacttgcccttcgtcacgccgagcgagaacaggaacaggatcgtgaagtcggtcgtcttctcgacgacgatcccgtgccggtcgagatacgcggtgacgaccgatgccggaatgccgaccggcatcagcccgccgtgcgatgcgacgcccggcgtgacgatcgacaccttgatcgggtcgagcatgcagtagtcgtcctcgatgtcgccgaagccgtgccacgtgtcgcccggatgcagtacccagcacgacgggtcggtggcgagcagcgtctcgtccgcttcgtggaagcgcacgcggcggcccgtcttgcgatcgacgacgttgtcgggctgccagccgttgaagaaccagtcgttgttctccgcgcattccgcatgcaggcgcgcaagcatctggcggaacgcgacggcctcgcggatcgcgtcggtcgtcagcgcctcgccgccggggccgtccatcatcgcggcgctcacgtcgttcgacgcgatgatcgcgtagttcggcgacgtcgacgcatgcatcatgtacgcctcgttgaagcgcgcatgctcgatcgggttgcggccgtcgcggacgtggatgaacgacgcctgcgacagcgcggcgagcagcttgtgcgtcgattgcgtcgcgaacaccgtcggcttgctcgcgtcgtgctgcgacggatcgccgtgcatcgcgtgacggtcgcggtagatcgggttgaagcgcgcgtagccgtaccacgcctcgtcgaagtgcaatcggtcgacgctctgcccgagcagttcctcgacacgtgcgacgttgtagcagaggccgtcgtacgtcgagttcgtgatcagcgcatgcacgggcgtcgggtcgatgccgtcgcggccgcgcacgagcgggttcgcgtcgatcgcgagccgcacggcggcggccgtcagccgttccggcatgatcggcccgatgatcccgtagtggttgcgcgacggaatcaggtaggtcggaatcgcgccggacatcgtcatcgcgtgctcggccgacttgtggcagttgcggtcgcacagcgcgacctggttgcgcgtgacgcttgccatcaggatcacgcggttcgacatcgacgagccgttcgtcacgtgatacgtgcggtgcgcgccgaacacgcgcgccgcgtagcgttcgctttcgccgatcgggccggagtggtcgagcagcgagccgagttcgccgaccgagatcgacaggtccgagcggaacagcgcctcgccgaagaattcgaagtacgcgcggccgaccggcgatttcaggaacgcggtgccgccggtgtgaccgggtgtgtgccacgagtattcgtacacgcgcgagaatttcgcgagcgcgcggaacatcggcggcagcacggtctcgcggtagcgttcgatcgcggcgacgatccgcccgccgatgaacgcggtggtgtcctccagcatccagatgaagtcgtcggccttgcgcatcgcgtcgacgggaatcgcggatgcgctggcacggctcgcgagcaggaacacgggcacggttgcgttacgcgcgcgcatcgcgtcgagcacggcctgcgcgggcgcgtggccggcgtcgttgccgagttcccagttgagcagcaggcactggatcgccggatcggcggcgacgaccgcgcaggcatcgtcggcagacgtcgcgatcacgacgtcgacgagccgggtgcgcagctcctcggcaagcgccgtcgcggcgcgcccggtggccgtgcgttcgtcgatgtcgtgctgcacgagcagcgccttcatgccgaggcggcggaaggccggttgggtcaaggatgcggtcatgtgtcattccccgtttgctgggttgcctgggcgctcgcggcaacggccggcgagcgcgcgtgaagggtgtcggcctggtgacggcccacggaaatccagaaggtcgcggcgagcgcggcgatggtcacgccgagcgcgagatagcgcacccagcgcggcgagcggccgcccggatgcacgtgggtttcctcgatctcgcgctggcggttgatcgacagctcgtagaagacgatcgtcgcgatgacgaagatcagcgaccagcgcgtctgctggccgtcggagccgaccatcgcccacagcgcgtagacggcgccgatcaggccgacgatcgtgtagaacgtgaactggtgcgacggcatcttgccgtagccgagcaccttgatcgcgatgcacgaatagatgtacggcagcagcgtcatgatcacggcgatcgacgcgatcttgccgaactgctcgctggcgctcggcgacatcgtcgcgagcacctgcaccgacatgatcagcgcgacgatcgcgaggccggccgacggcacgttcttcgagttgacgcgcgcgaacacgctggcgaacaggccgtcgtcggccgcggccttcgcggtctggccgaccagcagcgtccagcccgcgagcgagccgaggcagccgagcgccgcgcacagcgcgaccgcgttcgcggccgtattgccgagcgcgaggcgcgcggcatccgcgaacggcgcgctcgacgcgagcagcgccttgttcgggatcatccccatgatcacggtcgagctgagcacgtagcagacggccgcgagcaccacgccgccgacggtcgcgatcggcacgttgcgcgacgggttctcgacgacgccggccgacaccgatgcgctttccacgccgatgaacgcccacagcgtgaagttcagcgtcgcgccgatcgcgctgaagctgttggtgcccgacacgttccagccggcgaaatacacgtccttgctgaaccagaaccagccgaacacggccatcccgaggatcggcacgagcgcgaagaccgtcgtgaccgactgcacgcggccgacgacgttcggcccgaggatgttcgcgtacgtgaacagccagatcacgaagatctgcgcgagcgcgaacacgagcgggtccttcagtaccgggaagaaatgcgtgaggtagccgaggccggcgaccgcgaggccgacgttgccgagcacgttcgcgagccagtagatcaggttggtctggtagcccatgtacgggccgaacgacttgcgcgcatacgcgtacgggccgccggcggccgggtcgatcgcggcgagcttcgcgaacacgagcgcgagcgacacggcgccgacgacggtgatcagccagccgaagatcgcgatgccgccggtcgcggcgaggttcgcgggcagcatgaagacgccggagcccatcatgttgcccgcgaccatcagcgtggcgggaatgacgccgattttcggcgcggaagccgcgtccggcgtggcggcggcgcgggaggaggacgagctggcatcggacatgcgacgctccttgagaaggcgtgtttcggttgaggtgacgcggtgtggcgccggtcgacgattccggtgcggttcgtcgttttaattgacgcgttcatgttatcgctcggagcgattattaataagggtaaacgcttgtatttaataacttgaatattgatcaatgtcattgaagccggtgaaacggtgtttggcttcgggttcggcggcccgtgtggaaaggccggagcgcgtttttgccgatccggacgggtgggatcgtgccgcggaagcttcgaagaataatcgcttttactaaccggttaaatcaattcgcaatgcaaatggcgtggcaatcggagtttgagtttgtcggttattatcgggcgcattaaatgcgcgccgccggcgcgcgcgaccaccgcttcttccccgaggatgattccgatgacgacgctgccttcccgtttgccgctgatccaggccccgatggtcggttcactgagcccgctcgcgatcgccgtgtgcgaagccggcgggctcggctcgctcgcctgcgcggcactgggtccgcagcaattgcgcgacgagatcgcggcgatccgggcgcgcacgcccgccccgttcaacgtgaacttcttctgccatacgccgccggcgcccgatgccgcggtcgacgcgcgctggcgcgcggcgctcgcgggctactacgcggaagccgggctcgatccggccgacgtgaagggcggccccggacgcgcgccgttcgacgatgcgatgtgcgcggtcgtcgaagagctgcggccggccgtcgtgagctttcacttcgggctcccggacgatccgctgctcgatcgcgtgcggcgcacgggcgcgcaggtcgtctcgtccgcgacgaccgtcgaggaagcgctctggctggatgcgcgcggcgtcgacgcgatcgtcgcgcagggtgcggaggccggcggccatcgcggcatgttcctgaccgacgacatccatgcgcagccgggcctgttcgcgttgctgccgcagatcgtcgacgcggtgcgcgcgccggtgatcgccgccggcgcgatcgccgacgggcgcggcatcgcggccgcgttcgcgctcggcgcgcgcgcggtgcagatcggcaccggttacctgctgacgccgcaggccggccgctcggcgcagcatcgcgcggcggtgcgcgccgcgcgcgacgacggcacgcgcctgaccaacctgtacacgggccgccccgcgcgcgggctgctgacgcgcttcatgcgcgaacaggggccgatgagcgcgctcgcgccggcgtttccgctcgcgacggccgtggtcgatccgctgcgcggcgcgttcgagcggcagggccgcgacgacttctcggtgctgtggtcgggcgaggccgcggcgctcgcgcgtgaagaggatgcgggcgagctgacgcagcgcctgtggcgcgatgcgctggcatgtgcggcggggctgcgcgacgcgtttccgcaggcgcgctgagcgaccgggaagggggcgccggcgcgggagcatcggcgtatcatctgggttttcgtcagcccgatccaggcacccccaccatgacctccgtcgacactacccccgtcctcgaccatgacaagctcgttaccttcatcgagcgcaagtggaacgatgaaatcctccacgcactgaccgactacatcgcgatccccgcgaagagccctgcattcgaccccgactgggcgaagcgcggttatctcgagcgcgtcgtcaccgatgccgcgcagtgggccgagcgacagcccgtgaaaggcctgaagctcgagatcgtgcgcctgccgggccgcacgccggtgatcttcttcgaatcgcccgccacgcgctcgggcagcaccgacacgatcctgctgtacggccacctcgacaagcagcccgaattcgacggctggcgcgcggacctcggcccgtggacgccgaagtacgagaacggcaagctgtacggccgcggcggcgcggacgacggttatgcgatctacgcgagcctcgccgcgctcggcgcgctcgacgagcagggcatcgagcggccgcgttgcgtcggcctgatcgagacctgcgaggagtcgggcagctacgacctgctgccgtacgtcgacgcgctgcgcgaccggctcggccaggtgtcgctcgtcgtgtgcctcgattcgggcgccggcaactacgaccagatgtggctcaccacgtcgctgcgcgggctggtgtccggcgacctgcagatcgaggtgctcgaggaaggcgtgcattcgggcgtgttcggcggcatcgcgccgtcgagcttccgcgtgatgcgccagctgttcgagcgcctggaagatgcgaagaacggcaacctgctgccgggcgtgttccattgcgagattcccgacagccgcgtgcgcgaagccgacgcagccgccgccatcctcggcgacgccgtgtggaaggggctgccgtgggcctgcggcgcggacggcaagccggtgctgccgaccacgaccgatccgcgcgaggcgctgctgaattcgacgtggcgcccgtcgctgtcggtgaccggcgcggccggcatgccggcgctcgcggatgcgggcaacgtgctgcgtccgcgcaccgcgttcaagctgtcgctgcgcctgccgccgctcgtcgacgccgcgcaggccgtgcagcaactgaaagaactgctcgaactcgatccgccgtataacgcgaaggtcacgttcgccggacgcgggcgccgcgacgggctggagcgctccggatctcgcgccgtggctcgcgtcgtcgctcgatgccgtgtcgcgccgccacttcggcgccgattgcgcgtacatgggcctcggcggcacgatcccgctgatgaacgtgttgcaggaaggtttcccgtccgcccagttcatggtgtgcggcgtgctcgggccaaagtcgaacgcgcacggcccgaacgagttcctgcacgtgccgtacgcgaagaagctgacggcggcggtcgcggacgtgatcgcgaccgcgcgctgagcgccacgactgcccgacccgacctgacggaaccttgccgatgaccgccttgccgacgcccgataccaaaccgctgcgcatgcgcgccgaaccgctgcatgcattcgtcgcggcactctgggaacgggccggcagcagcgagcgggaggcacggctcgtcgccgatcacctggtcggcgcgaatctcgcgggtcacgattcgcacgggatcgggatgatcccgaactacgtcgcgtcgtggcgggaagggcagttgcagttgaacgggcacgcgtcgattgtccgcgacggcggcgcggtgctgacgatcgacggcgggcgcggcttcggccaggtgatcgcgttcgaggcgatggtcgaagggatcgagcgtgcgcggcgcatgggcatctgcgcgatcgggctgcgcgacgtgcatcatctcggccgcatcgggcactgggccgagcagtgcgcgcgcgcgggctcgtgtcgttccatttcgtcaacgtgccgggcgacctgctggtcgcgccgctgcacggcaccgatccgcgcttcggcacgaacccgttctgcgccgcgtatccgcgtgcgggcaggccgccgctgctgctcgatttcgcgacgagcgcgatcgcgtacggcaagacgcgcgtcgcgcacaaccagcgcaagcgcgtgccggccgggtcgctgatcgaccatcgcggccagccgaccgacgatccggccgtgatgcacgagcagccgttcggcgcgctgctgccgttcgggctgcacaaggggtacgcgctggcggcgatgtgcgagattttcggcggtgcgctcgtcggcgggcatacgacctacggcgacacgctgcagaagacgagcgcgatcgtcaacgggatgctgtcggtgctgatcgacccgaaggcattcgatgcggccgatgccgagcgtgaggccgatgcgttcgtcgcatgggccaaggcgtcgccgcaggccggtgacgcgccggtacaggtgcccggcgagccggaagagacgagccgcgcggcgcggggccggcggcattccggtcgatcgcgcgacgtggcggcagatccgcgagagcgcggcggcggtcggcttcgacgacgcggcgctcgacgcgtggacgcagcgttgcacggagcgcgcatgagctggcaatcggagaaggcgcacggcgaggagatcgcgtatcagctcgcgccgctcggcaaggtcgaggtcgcgcggttcttcagcggggcggcgatgcggctcgatggcgtgatgttcggcttcatgtcgcgcgggtcgctgttcctgcgtgtcgacgacgtgaaccgtccggcgttcgtcgcggcggggatggggccgttctcgtatgcgaggcccacgcgtaccgtcgcgctggagggctactacgaaaccccggccgacgtgctcgaggatgcgggtgcgctgttcgactggtgccgcagcgcgtatcgcgcggcgctgctggcggggccgccgaagcgaaagacgagggcggcggcgaagccggtgccggaggcggaaccggtggcgaagcgggtggcgaaagcgacggcgaagccggcggagaagtctgcggcaaagccggcagtgaagcgggcaacgaaaccggcggccaagccagcggcaaaggcggcagcgaaaccgacggcgaaaccagcagcgaaaccagcaactaaaccaccggcgaagcgcaagcaaacctgatgccggtcgagcgaagcgacaccttcgcgaatttcgctttcctttctttcgatctcgaacgtgtcggggcgattcgcgcgacgcgcggcgcatgacgggtgccaggcggtgcgcccgcgcaggcgcgttaagtcatgcggcttgccgcaccgcacatccccgtgcttcacaacggcggccccggcgtttatgatcggcgcgggttgcacccgtgactggcgcgacccgcgccggcctcgccgccggctccaacgaacggcgcatcgtatgccgcgcgggacgcttcccactcatcattccagacggagacaaccgatgctcgtcctgattctcggtttagcgatcttcctcggtgtgcactcgatccggatcgtcgcggacggctggcggtcggcgacgatcgagcgaatcggcgagaaaggctggaagggcccctatgcgatcgcatcgatcgtcggcttcgtgctgatcgtctggggttacggcatcgcgcgccagggcgcgacgctgctgtgggtgtcgccggtcggtgtgcgccacctcaccggcatgctgaccgcgatcgcattcgtgctgatcgccgcctcctacgtgcccggcaaccgaatcaagacgctcgtcggccatccgatggtggccggcgtggcggtctgggcgatcgcgcacctgctcgcgaacggcacgctgcacgccgtcgtgctgttcggcgccttctttgtctggtcgctcgtcgatttcgtcgtgtggcgcgcgcgaccgccgcgaaggcgttcgttatccggcgggcaggctgtcgggcgacgtcgtggcggtcgtggccgggctcgtcgtctgggccgtcttcgtgctgttcctgcacggctggctgatcggcgtgcggccgttcggctaagccgccaggcacttgagcggctgagccgccgagggccgagagccaagcggttgagcaactggctggccgagcggcgccggccagcgcgccgcacgccgagggcaacggtcagcgcagcttcgcgccggccgtttcgccgagttgcgccggcttgcggcgcaggaaatacgccgcgacgatcgcgagcgccgtcgataccgtgaccagaactggaagcgcgaatccgggttgaatgcctgcgagccgagcacggcgacgagcgccagcagcgcgacccagttcgacaccggatagaaccacgcgcggaatgccgccgggtcgcgtcgctcgtgcttcgtctgccggcgcatcgcgaagtgcgcgacgatgatgaagatccacacgatcatcacgaacgcgccgctgctttcgcgagcatcaggaacaggtcgccgccgctcacgaagtgaacgccgaggatcgacacgcagatcgcgaggcacagcacgagcgcgttcatcggcacgcctttcgcgttggtacggccgaacatcgcgggcgcgtgcccgcgctggctgagcgagaacagcatgcgcgagttcgagaacaggaacgagttcatcaccgacatgaacgacacgaacagcacgatcttcatcgcgacggccgcgcccgtgaagcccgccatcccgaacagcgacacgtacggcgatttcaggttggccttgtccgtccacggcatgcacaggatcaggatcgacaccgagccgacgtagaacaccatcacgcgcacgatcacgctcttgatcgcgcggatcacgttcttgctcgggttctcggattcgcccgccgccacggccgcgatttcgctgccgccgagcgagaagatcacgaccatcacgccggcaagcacgggcgaaatgccgttcggcatgaagccgccgtgatccgtgaggttcacgagcccgggcgccggaatgcgcggctggaagccgagcaggatcgatgcgccgagcgccatgaacacgacgatcgtcgcgaccttagcgaacgacagccgtattccgcttcgccgaacgagcgcaccgagtacgcgttgctcgcaatcagcgtcacgagcatgaacagcgcgccggcccacacgggcagccacggcaggaaatcgttgaggatcgcgccgagcaggatcgcctcgacggtgatcgtcatcatcgacttgaaccagtacagccagccgaccgcgaagccggcccattcgccgagatgctgctcgcgtaggtggagaacgagccgctgtcgggattgcgggacgccatttcgccgacatgaacatgacgagcgtgacgatccgccgccgatcaggtcgtcagtggcgccgcggggccggcggtcgcgcgtgatcgcgtcggagccgacgaacgaggcctgcgccgggctcgccgccaagcgcgatcgcgagattgccgttgccgaggcttgccgcaagacgctgtcgagcattccacgctccgttacgttggccgggaacgcatcgaagcattggcggaactgccgccgttgggcgccgatgcggggcgtgtgtgacggatgtgccgggccgccggcggccccgtcggaatggcggccgcgtcgtgccggcgtgcccgcggcgcgcgatcacgcggcgatccggtcgtggcggaacagccggcattcgagcgcgccgttgaacagcggcgtcttgcggattgcgcagccgctgccgtggcagcgagcggacgtcagcagaacgcctgccgcccaaaccgctgcttcagcgcatcgccgagcgcgatcccgccggtgccgcgtgtcgttgcgcggcgcgccgtcgttgccgcgcggcccgctcgcgcacctcgccgccgccgcgcggccgcgcccctgcggtcggcgacgtcgggcgccgacgccgggcgtcatcacgcgcgagcgcgcgcgtcgacctcgcgtgacgcggcgacggccggccgcgcgcacggccttcgcgtgccgagccgtcgccgcgtcgccgccgtagcgcgagcgcttgccgcgcgccgcgcgccgcgcgccgcgtgccgggccttcagcccggcttgcggtgatgcttgacgcgaacgaaccggcgcgacgccggccacggccgagcgcgcgctcgccgaacggcgcagccgccggcgcgccgtcgtacagcgccgtgccgggcgtccagcccgtcaggcgcaggatgccggccgcgaggttctcgcggcggcgccgcgccggtcgaggcgccagcggcttgaacagcggctcgccgacgtgaggtacagcgtgcactcgttgcgtcaggaacgcgaacacgcgcacgtcgggcgcaccggtatcgatgctcgggcgcgcgccggtcttctcgcgcatccggtcgcagatcgcgtccttcacgcgcaacgtcgcgaattcgaggctcttcagcggcgacttgatcgcggtgatgtcgacgcgcagcgtctgcgtcgccgcgaaccagcgcaggcgctcgagcgcgagcgcgtagacgtcgtgcaggcgcgcggatcttcagcaggacccggctcgcgatccgcgaatggaggttcgcggccatgccggcggcccagccgccgctgaagtgcgccgcccggcacctgcgcggccgcggtgaacggcgcgccggcaggtggcggccggcgatttcggccagctcggcggcgagcgcgccgaggggcgggagggggcgaagaattcgtacagggtgggcgaggacataaggcgggtgaggacgtgcaaagtccactattgtacgcggcgcgggcggccggggccggcgttgcgcgcggcgccgcgcgcgcgcgggcccggcgccgcggtgcccggcggcccggcggtgcccgggcgggcaccggcaggccgccgcgggctcagtgcggcccggcgcgggcggccgggctgctgcccggccagaacagcgcgagcggattcgacagcaccgtgcggacgatcgcggcgacgagcgcgcgcaccttggtcggacgcaggctgcgcgagcgcacggccatcgtgaacgcgagcgcgaagctcacgagcacgttgaggatcgccatgctgagcacgccggcgccggcccaccacagctcggggtgcccagcgcgtccttgcccagcacgccgagcgcgatcccgatcgaaccggccgacagcgtcacgtgccgcacctcgaacgggaacatgaacacggtgacgatcgccgggatgaggccgagcatcaggccgaggccgacgttcgcgaccacgccggccacgttcgaccggcagaaatgcgcgagcttcgcggcgccggccgcgccgagcgtgaggcgcaggcggcggttgtacgtgagcgcgtcgccgacccggtgcagcacgaaccagttgtcggcccaacccgcgagcaggctcgacgcccacagcagcacgccggtcagcgccgcgtagagcggcgtcgggccgagcagcgagaacgagtgcagcgtcgcgtgcgccttctccggcgagatcaggttcgcatgcagcaggttgctggcgaacagctgcaccagcaggcacacgggcagcacgacgagcacgttgcccgaaatcgcggcggcctgcgtgcggatcagcgcgatcaccgatgccacgaacgccttcacgccttcgtcgtggcccgtgtcgtccagctcgcgcgcgagcgtcggcgcggtcatcgcaggctgcttggtcgcgagcgtgaagtgcaggaagtgcatcagcatgaagctggccgcgtagttgacgcccgcgagcagcccttcgagcatcgactgcaggtgcgcgcccgtgatcgcgaacttcacgcacaccgtcacgacggtgacgaggccgccgcccgcggccatccgcagcatcttcaggtactcggcgcggccgcgcgagatgtagtgctcgccggtgtccgcgttggtttcgacgagcttgcgcgcgaacagcgagaagttgctgcgcacgaggtgcgacacgctctggctgttgtggttcgcgtcgacgagctcggccgtcaggtgcgccatcccgtgcaggtcgtcgcgcgccatccacgcgttgagcagcatctcggcgcgcaggatgcgcatgcgcatccgctcgacctggaacacgatgtcgaccgacacgccgttgcggtacaggtgcgagaacacctcgtcgacggcgatccggcattcgtcgagcagcacgcgcaggtagttgacctcgtgcagcagcttgctcgggtcgccgccgtcctcgacggccgcgtgcgcggtctcgaccgcgagcatcgcgcgcgtgaggcgatagaacggctgcgtttccagcggcttgcgcgcgtcgtcgtcggagagccggctgcgcaccgtctgcgacaggccggtcgagctgatctggcaggtcaggttgtgcagcgcggccagcaggtcgcgcgagaacgaacccggctcgtggcgctcttcgtcggtgacgtcgaacgagaacaggtcggcgaggcgcgtgaggagatcgtcgggcagcgcgtcgatccattgcgcgtcttccggcgtcgggaacatcagcgtgaagagcgccgacagctcgcggcggttcggcgccggcgggatcagcgacgagtcgatccgctcgaacagcgcgccgaagaagcccgagtgcacgggcatgccggcgtcgcacaggagcgagatgccgtcgcactcgcgcaggatgccgcgcaggatgcgcgcggcgtgcgccttccatgcggggttgcgatcgagcacgtggaacaggtagcgcaagcgcgcgtgggccggatacgcgcgcgcatcggcgtcgcgatcggccggcgcgtcctgcatcgtgccggtgcggcgcagccagtgcgcgagctcgatcagccattcgctgcgctcggcgtacgacgcatcggcgtcggcgtgcgcgagcagcgcatcgagctggtgaccggcattgcgcgacgcgcgccacttcttgatcagggtcgtcagggaacgaaacataaacggaatagcgaaagccctcggcgggcgggttcgggatgccggccgggaaacggcgcggcgccggggagaacgggtgagacggggcaggttgccggacgatgcgaggcgacccgcgatgcggctgccccgctgcggtgcacggtgcgggcgccgggcggcacggcggtcgggccgaacacggcccggcgccgctggctggcgcgcacgacgagcggcgcgggcctgaaagtgcgtaggatcgtcaatcgggccggaaaacgcaagccgaccgcgttgcacgaagccggttccggccgactttgacaaacaatgtcatggccgtccggccggggagcgcgacgcggggccggggccggccgcggcagcgcatcgccgacggcggccggcggtcgctatcggacgcgccgcgctggacgaagccgcgcaggcgcgtacgccgtcgagcgttcgcctgcgcgccgcacgcttacgcgccggacttgcccgtcgcgccggcgtcgccgcccggcgccggattggccgggcacggcacgaccggcgcggcggccgtcttgccgccggccgcgggtgccgcggcagccgatgcgccacggcgcgcggccatggcacgcacgccggccgcggcttgcgtggcgatcacgtcgagcgcgcgccggtggccggcgacgagtgcgtcgtagccgtcggcgaccggttcggcgacgctcgtgcggcaggtcatcacggcctgcgtggcgagcgagcgcacgctccacacggcatcgaccgccgcgcgtttgcccggccacgactcgaagcgctgcacgttcacgctgatgcgatacacgggcacgccgggcggatacgcggaattcgcgacgtcgatcgtgccgagccgcgcggcgagatcgtccgacagcgcacggcggatctcgtcggcaggcggcgacgcccagcgttcctgctcgagcacgtcgacctgcgcggcgttcttctgcacgaccagctggttcttcgcgacctgctcgggcacgccgacggacggcacctcgatcaggaacgccgggttggccggcgcggtgcgcagcggcgccgcggcgtcggccgggctgagcgtgtagaaccgcgcgggcggcgagctgcacgcggcgagcgcgagggcggcggcaaccgccgcagcaccgctcgcgaaaccgttcacgcgtgtcgtcatggttgatctcctggcttgcccttgagcagcgattcggggtgacgctcgaggtagtcggcgagcgcgttcagcgattgcagcgtgcgcgtgagttccttcagcgcgccgcgcacgtcggactgcagcggcgaatcctgctgcagcgtcgcttcggcggtcgagaaggtctgcttcgcggccgacagcgtgtcgcgcgcttccggcgcgacctgcgtgtcgagctgcttgaacagcttgtcggcgttcgcgagcgcgctgttcaggttcgcgccgatctggtcgaacggcaccttgtcgagcttcttcgcgatgtcggcgacctgcagctgcagctcgtcgagcgtgttcggcacggtcggcagctcgagcggctggcgtgccgtgtcgatcttcacggccggcgccttcgggaagaagtcgagcgcgacgtacagctggctcgtcagcaggttgccggtgcgcagctggccgcgcagcccgtgctggacgagccgctcgacgatctcgcggcgggccggttcgcccttgctcgatcgtttcgcggaagcgccggccgaggcgttccggatagatgttcatcgtcaccggcatcaggaagttcttcgtcttcggatcgaagtcgataccgatgttcgtcacttcgccgagcacgatgccgcggaagtcgaccgtcgcgccgacggcgagcccgcgcagcgactggttgaagttcatcacgacctgcagcggctggccgtccgggtcgcgcatcgcgtcgccctcgtcggacgcgaggcggaacgtggtgttgttcggcgcggtcgtgccggagccctggttcggcggcgtctggaacgcgatgccgccgaggatcaccgtcgcgagcgactgcgtgttcagcttcaggccgctcgaatcgagccgcaggtcgacgccgctcgcctgccaccagcgcgagttgatgccgacgtactggtcgtacggcgcattgacgaacacgttgaacgtgacgcccgtgccgtccttgtcgagcgagaagccgaccacctggccgacctgcacgcggcggtagtagaccggcgagccgatgtcgaccgagccgagcgaatcgccgcgcagcacgtactgcgtgcctttctggtcgcccgtgacggccggtggcgtctcgaggcccgtgaaatcggtcagcgtgtcctgaccgcggccggcgtcgacgccgatgtacgcgcccgacagcagcgtgccgagccccgacacgccggtcgcgccgacgcgcggccgcacgatccagaagcgcgagcccttgaccgcgaagtcctcggcttccttcttgagctgcacctggacgagcacgcgcgacaggtctttcgacagcttgatcgtcttgaccatgccgatctcgacgtccttgtacttgacctgggtcttgccgggctcgagcccttcggcgctgtggaagctgatcgtgatttccgggccgcgttcgcgcacggacttgatcacgaggccgatgccgatcagcgcggcgatcagcggcacgagccagacgagcgacggcagccagccgcttttcgtcgagatcgtcggatcgggcggccggggcgcgtcgtgctgcgggccttgtggactattcatggtgattccctgaggtttcgactggatcccagatcaggcggggatcgaactgcatcgacgcgagcatcgtcaggatcacgacggaaccgaacgcgagtgcgccggggccggccgtgatgacggcgagcgaacggaaatggacgagcgcgacggtcagcgtcacgacgaagatgtcgagcatcgaccagcggccgatgcgctcgacgatccggaacagccgcgtgcgctgctgcggccgccatgcggtgcggcgctgcgcgctgatcacgaggatcagcaatacgccgagcttgagcatcggcacgaggatgctcgcgacgaacacgacgacggcgagcggccagtcgcccgacacccagaaatagatgacgccgctcatgatcgtgtcttcctgcgagccgacgatcgacgcggtgcgcatgatcggcagcaggttcgccggaatgtacaggatcgcggccgcgagcagcagcgcccacgtgcgcatcaggctgttcggcgtgcggaaatggagcgcgctgccgcagcgcgcgcaatgcgcgtgcggatggtcgagcgtctgcacgagcccgcacgtgtggcagctgacgtagccctcgcgggcggcggtcgggatcgtcatcggcgggcggcttccggcaacggggcgcgtcgggctgcccgggcgagcgcccggcgcgcaggtcgtcgacgatgtcccacagcgtgcgcggatcgaacatcagcaccacggcgatcatcagcgtgagcgcggcgaacgcgaacagcgcggcttccggcacgacgcgcgcgaggctcaccatcttgacgatcgtgacgaggatcccgagcatgaatacctcgatcatccccacggccgcaccatctcgatcgcgcgcagcacgaggttgaaaccgggcggcacgaccccgcggcggatcggcagcagcaggtacagcagcgcggccatctcgacgagcgggaacagcacggtcgagcagaacaccatcacgccgacgatcgccatgtcctggcgccacagcgagtcgatcgcgccgatcagcgtggtctgcacgcggttgccgttcacgtccatttcgaggatcgggaacgcctgggcaatcgtgaacgtgatcagtgccgcgagcgcgagcgcgcagatccgctcgatctgcgccgcgctgttgcgataaagcagcgcgtcgcagcgcgggcaacgcgcgatttcgcggccgctcaggcgcggtttgtgcaacagtgcgtcgcactcgtgacaggcaatcaggtcgtatcgttgcatggaaaaggcagttgtgcgacggccggggacacgcgtcgacggggccggaacccgcgccaatcttaccaaaagggccttttcggcgtgtcaaggatcgtgcggtttgtgaccggccggtaacatgacgggaagctgtcggccggctgacatgcctgtcctcagagtccgcgcgcgtcaaaaggttgcggtagcatggcgcccttgacaagcgtcggacgaatggccggcgcggctgttcgctgaactgaggaatccaggatggtatcgaaatcgccgccggccgtgccggcacgttatgcgcataccgcgatcgcgctgcactggctgatcgcgctgctgatcatctgcggcttcgcgctcggctgggtgatgaccgacatccccggcttcacgccgaccaagctgaagtacttctcgtggcacaagtggatcggcgtgacggtgttcgcgctggccgtcatccgcgtgctgtggcgtgcgacccacgtgccgccgccgctgccggccgatacgccggcgtggcagcgcgtggtatcgcacggcgtgcacatgctgctgtacgtgctgatgatcgtgatccccgtgacgggctacctgtacagctcggcctcgaacatcccggtcgtctacctcggcatcgtgccgctgccgcggctgatcgaccccgatccggtgctgaaggaaaccttcaagacgctccacgtgtccttgaattacattctgcttgcgctcgtcgcgatgcacgtgctcgcggcgctcaagcaccagttgttggaccgcgacggcctgctgtcgcggatgcttccctttgccaaatgaaggatcccatgaaagtgtctttctcccgctccatgctgaccgcgctcgccgcggtgtcacttgtcgcgtcgggcgcggcgcacgccgatgtcgatctcgcgaagagcaaggtgtctgccgtgtcgaagcagatgaacgtgccgaccgaaggcgcgttcaagaagttttccgcgcaggtgaagttcgatccggcgaaggccgcgcagggcagcgcccagatgacgatcgacgtcgcgagctatgacctcggcgacaagatgtacaacgaccaggtcgccggcaaggactggttcgacgcgaaggctttcccgcaggcgacgttcgtgtcgtcggcgatcgcaccggccggcggcaacaagtacaacgtgaccggcaagctgacgatcaagggcaaggccgaaaccgtcacggtgcccgtcacggtcacgcagaacggcgcgacgcagacgttcgacggcgtgctgccgatcaagcgttcggccttcaacgtcggcaccggcgagtggaaggacacgtcggtcgtcgcggacgaagtgcagatcaagttccatctcgtcgccacgaagtaagcggcgaaccatcgcatcacccgaatgccgcgcgagggcgcggcgccgttccaaggagaaagagttgaaaaagcatctgatgatcgccgcgggcgcactggctgccacgctgtcgttctcggcattcgccgacagcgcaacctaccagttcgatccgtcccacacgtacccgagcttcgaggccgaccacttcggcggcctgtcggtctggcgcggcaagttcgacaagtcgagcggcaccgtgacgctcgatcgcgcggcgaagacgggtacggtcgacgtgacgaccgacatcgcgtcgatccacaccggcagcgcgaagctcgacgagcacctgcagacgaacgaattcttcgacgtcgcgaagttcccgcaggcgaactacaagggcacgatcaagttcgacggcgacaagccggtgtcggtggtcggcaacctgacgctgcatggcgtcacgaagccgttgacgctgaagatcgactcgttcaagcgcatgccgcatccgatgctcaagcgtgaagtctgcggcgtcgacgcggtcggcgaattcagccgcgacgatttcggcctcgactacggcaagcagtacggcttcaagatgaagacgaagctgctgatcacggccgaagccgtcaagcagcagtaataccgccagccgggccggccgccgtgccggcccgtcgcgccaaccgccgcgttcccgttccacgggcgcggcggtttttttgcgcgcctataatcgcccgagcgccgctcgcggcgcccggcggcgccgacggcgcgcgcgtggccgcggccgcctcgaacagaacgtacaacgacaaggagatcgccgatgcatgccgtcacgcagtcccgtcccattgcctcgtcgccgcgcgtgtggcgcgcggtggtcgccgcgtcgatcggcaatgcgctcgagtggttcgatctcgtcgtctacggtttttcgcggtgacgatctcgaagctgttcttcccggccggcaacgacaccgtgtcgctgctgctcacgctcggcacgttcggcgtgtcgttcttcatgcgcccgctcggcgcgatcgtgctcggcgcgtacgccgaccgcgcgggccgcaaggccgcgctcacgctgtcgatcctgctgatgatggccggcacgctgatcatcgcggtgctgccgacctacggggcgatcggcgtcgcggcgccggtgatcctcgtcgccgcgcggctgatgcagggcttctcggccggcggcgaattcggcagcgcgaccgcgttcctcgccgaacacgtgccgggccggcgcggcttcttcgcgagctggcaggtcgcgagccagggctcacgacgctgctcgccgccggcttcggcaccgtgctgaacgcgcagctctcggccgagcagatggcgtcgtggggctggcgcgtgccgttcttcttcggcctgctgctcgggccggtcgcttactacatccgcacgaaggtcgacgagacgcccgaattcctcgcggcggaaggcaccgcgaacccgctgcgggacacgttcgcgtcgcacaaggcgcgtctcgtcgccgcgatgggcgtggtcgtgctcggcaccgtcgcgacctatctcgtgctgttcatgccgacctacggcgtgaagcagctcggcctcgcgccgtcggccgcgttcgcggcgatcctcgtcgtcggcgtgatccagatggtgttcgcaccgctcgtcggccactggtcggatacttacggccgcgtgcgtgtgatgatcgcgccggcgatcggcatcctcgtgctgatctatccggcattcgcgtatctggtcgcccatccgggcttcggcacgctgatcgccctgcaggtgctgctcgcattcctgatgacgggctacttcgcggcgctgccgggtttgttgtccgaagtgttcccggtgcagacgcgcacgaccgggatgtcgctcgcctataacgtcgcggtgacgatcttcggcggcttcgggccgttcatcatcgcgtggctgatcaaggcaaccgggatgaagacggcgccgagcttctacctgatgttcgcggccgtgctgagcctcgcggcgctggtcgtgctgcgccggcggttcggcttccggtaacggggcaggcggcgcgcgtcagttgccggcgcgctcgcacacgggttgcgcgggcatcagttgcggcttggcgtcgatggttcgcacggggcgccccgcgagcgcggcaagggcctgcccgagctgccagtcggaggccgtgccgaactcgcgctgcggcagcgccgcgctcttcgccgagtcgatctttgcaagcgcacgctgctcgcgcagcttctgccgctccttgcgcaccttcgcgaacgggtcgggcgccagccggtcggcatatggcgcgcgcgggagatcggcttcgcggtaccacagcagcacgccgtcgacgtccgagtcgcggcgcggcggcacgagccagtccggcaccacgccgtagccgtccatcgggcagccgttcggccgcaggttgcgcgcgaacgtgaaattcaggcgcgtgccgtcgatcaggtcgacgcccgtctgcgcgagcccctttccgtaggtcggcatgccgagcagcttcgcgcggccgagatccttcagcgccgccgcggtcgcctcggcggccgacgcgctctgtccgtcgacaagcacgacgagcggcacggtgcgccaccagtcgtcggcctgcaacggcgcgagcggatcctgtccgtgcatgaccggcaacgcgtaatcgggccagttggtcgtagcggcgccggttggcgtcgccgcgctcgaccgtcaccatcgcggtgcgatcgcggcccgcgtacagcgcggtgatgccgatcgccgcattgagcgcgccgccgctgttgatgcgcaggtccaggatcacgcctttcacgggcggcccgcgcggcgtgcggcctgcaccgcgtcgatgtaggccgaccgcgggttccgggaagctcgacagccgcgtgtacaggatgtcgccggcgagccgtttcgcggtcgcggggtgcggcttgaggatcgtccgcacgggcgcgaagctcagcatcgcgtggaccgcgctgtaccgtgagcttcagcggcacacccgcgtcgcccttggcgagcttggtcaggtcggcggcgtcgatgccgacgacgctcg
